US011453917B2

(12) United States Patent
Fang et al.

(10) Patent No.: US 11,453,917 B2
(45) Date of Patent: Sep. 27, 2022

(54) ANALYSIS OF Y-CHROMOSOME STR MARKERS

(71) Applicant: Life Technologies Corporation, Carlsbad, CA (US)

(72) Inventors: Rixun Fang, Menlo Park, CA (US); Manohar Furtado, San Ramon, CA (US); Manfred Kayser, Rotterdam (NL); Kaye Ballantyne, Macleod (AU)

(*) Notice: Subject to any disclaimer, the term of this patent is extended or adjusted under 35 U.S.C. 154(b) by 0 days.

(21) Appl. No.: 16/840,168

(22) Filed: Apr. 3, 2020

(65) Prior Publication Data
US 2020/0299786 A1 Sep. 24, 2020

Related U.S. Application Data

(63) Continuation of application No. 15/947,750, filed on Apr. 6, 2018, now abandoned, which is a continuation of application No. 14/624,185, filed on Feb. 17, 2015, now abandoned, which is a continuation of application No. 13/613,578, filed on Sep. 13, 2012, now abandoned, which is a continuation of application No. 12/880,040, filed on Sep. 10, 2010, now abandoned.

(60) Provisional application No. 61/379,340, filed on Sep. 1, 2010, provisional application No. 61/367,346, filed on Jul. 23, 2010, provisional application No. 61/241,778, filed on Sep. 11, 2009.

(51) Int. Cl.
*C12Q 1/6888* (2018.01)

(52) U.S. Cl.
CPC ..... *C12Q 1/6888* (2013.01); *C12Q 2600/156* (2013.01); *C12Q 2600/16* (2013.01); *C12Q 2600/172* (2013.01)

(58) Field of Classification Search
CPC .................. C12Q 2600/156; C12Q 2600/16
See application file for complete search history.

(56) References Cited

U.S. PATENT DOCUMENTS

| 2003/0224372 | A1 | 12/2003 | Syndercombe-Court |
| 2006/0088874 | A1 | 4/2006 | Bacher et al. |
| 2009/0117542 | A1 | 5/2009 | Maybruck et al. |
| 2011/0263437 | A1 | 10/2011 | Fang et al. |
| 2013/0109579 | A1 | 5/2013 | Fang et al. |
| 2013/0137589 | A2 | 5/2013 | Fang et al. |
| 2015/0267264 | A1 | 9/2015 | Fang et al. |

FOREIGN PATENT DOCUMENTS

| CN | 101225386 | 7/2008 |
| EP | 2055787 | 5/2009 |
| KR | 2001105503 | 11/2001 |
| WO | WO-2009/059049 | 5/2009 |
| WO | WO-2011032054 | 3/2011 |
| WO | WO-2012/067901 | 5/2012 |

OTHER PUBLICATIONS

Frazier, R.R.E. et al., Validation of the Applied Biosystem Prizm 377 automated sequencer for forensic short tandem repeat analysis, Electrophoresis, vol. 17, pp. 1550-1552 (Year: 1996).*
Unknown, "Stratagene Catalog", *Gene Characterization Kits*, 1988, cover and p. 39.
Aler et al., Population study of eight novel Y-chromosome STRs (DYS460, DYS461, GATA-A10, GATA-C4, GATA-H4, DYS434, DYS437, DYS439) in a southeast Iberian population: looking for highly informative Y-chromosome haplotypes. *International Journal of Legal Medicine*, 2003, vol. 117, No. 2, 127-131.
Alves et al. Evaluating the informative power of Y-STRs: a comparative study using European and new African haplotype data. *Forensic Science International*, 2003, vol. 134, Nos. 2-3, 126-133.
Arroyo-Pardo et al. Genetic variability of 16 Y-chromosome STRs in a sample from Equatorial Guinea (Central Africa). *Forensic Science International*, 2005, vol. 149, No. 1, 109-113.
Asamura et al., "Evaluation of MiniY-STR Multiplex PCR Systems for Extended 16 Y-STR Loci", *International Journal of Legal Medicine*, vol. 122, Springer-Verlag, Sep. 26, 2008, 43-49.
Asamura et al., "MiniY-STR Quadruplex Systems with Short Amplicon Lengths for Analysis of Degraded DNA Samples", *Forensic Science International: Genetics*, vol. 1, 2007, 56-61.
Ballantyne, et al. Additional Y-STRs in Forensics: Why, Which, and When. *Forensic Science Review*, 2012, vol. 24, No. 1, 63-78.
Ballantyne et al., "Mutability of Y-chromosomal microsatellites: rates, characteristics, molecular bases, and forensic implications", *American Journal of Human Genetics*, Sep. 10, 2010, 341-353.
Ballantyne et al., "A new future of forensic Y-chromosome analysis: Rapidly mutating Y-STRs for differentiating male relatives and paternal lineages", *Forensic Science International: Genetics*, vol. 6, 2012, 208-218.
Benson et al., "GenBank", Nucleic Acids Research, vol. 37, Supp. 1, Jan. 2009, pp. D26-D31.
Bosch et al. High resolution Y chromosome typing: 19 STRs amplified in three multiplex reactions. *Forensic Science International*, 2002, vol. 125, No. 1, 42-51.
Butler et al., "A novel multiplex for simultaneous amplification of 20 Y chromosome STR markers", *Forensic Science International*, vol. 129, 2002, 10-24.
Butler, "Genetics and genomics of core short tandem repeat loci used in human identity testing", *Journal of Forensic Sciences*, vol. 51, No. 2, Mar. 1, 2006, 253-265.

(Continued)

Primary Examiner — Teresa E Strzelecka
(74) Attorney, Agent, or Firm — Workman Nydegger; Logan Christenson; John Guynn

(57) ABSTRACT

The methods and compositions provided herein relate to the discovery of 13 STR markers, found on the human Y chromosome, having surprisingly high mutation rates when compared with 173 other Y-STR markers known today. The set of RM-Y-STRs may overcome the current dilemma of Y-chromosome analysis in forensic applications due to their extraordinary mutation properties. Embodiments of the invention include methods for allelic determination of rapidly-mutating Y-STR markers, amplification primers for the analysis of rapidly-mutating Y-STR markers, allelic ladders for analysis of rapidly-mutating Y-STR markers, and kits for the analysis of rapidly-mutating Y-STR markers.

17 Claims, 49 Drawing Sheets

Figure 1:
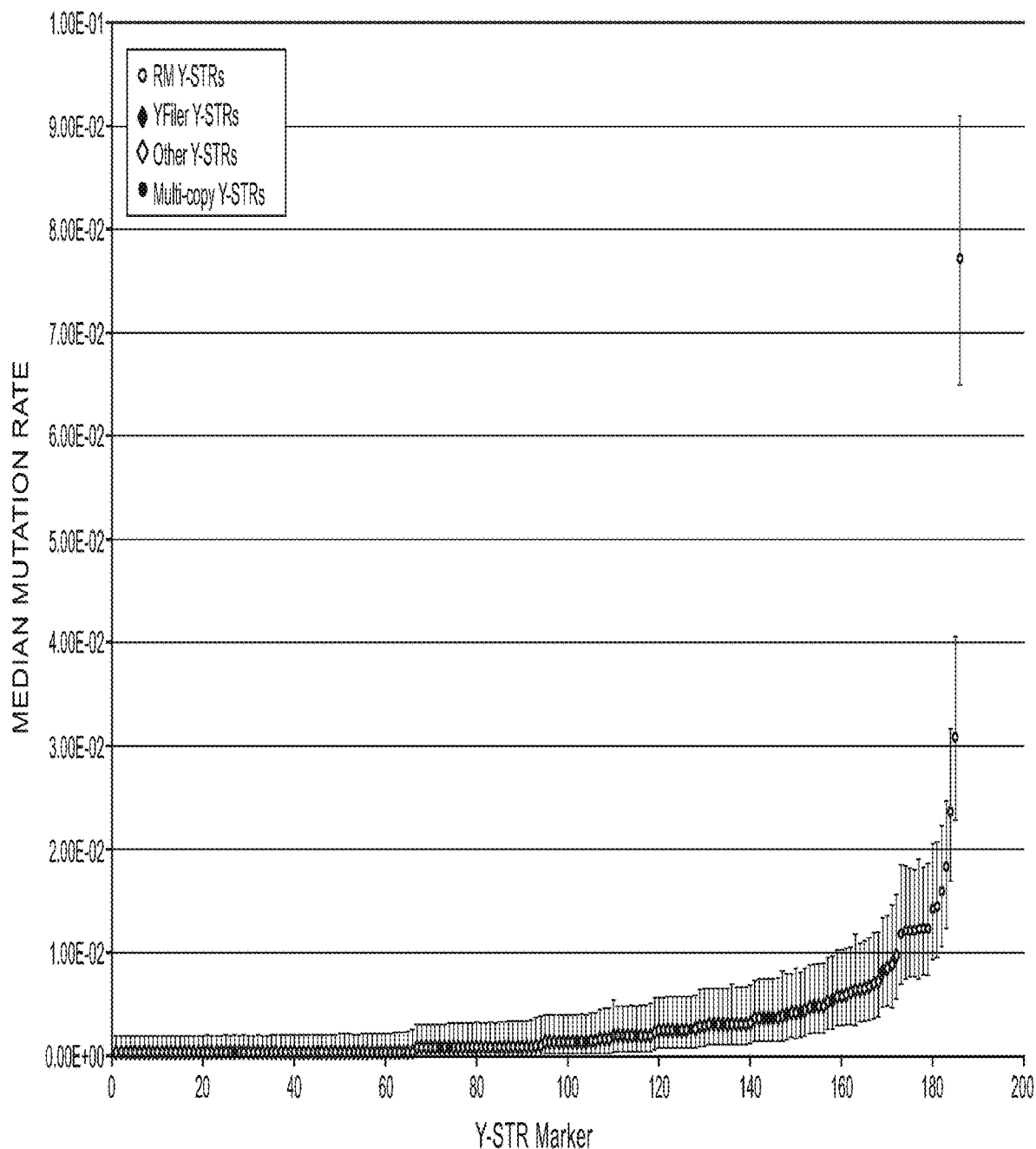

Specification includes a Sequence Listing.

(56) References Cited

OTHER PUBLICATIONS

Butler et al., "Allele Frequencies for 27 Y-STR Loci with U.S. Caucasian, African American, and Hispanic Samples", *Forensic Science International*, vol. 156, 2006, 250-260.
Butler, "Constructing STR multiplex asays,"*Journal Methods in Molecular Biology, Forensic DNA Typing Protocols*, vol. 297, 2005, 53-66.
Coble et al., "Characterization of new MiniSTR loci to aid analysis of degraded DNA", *Journal of Forensic Sciences*, vol. 50, No. 1, Jan. 2005, 43-53.
D'Amato et al., "Evaluation of 21 Y-STRs for Population and Forensic Studies", *Forensic Science International: Genetics Supplement Series 2*, 2009, 446-447.
D'Amato et al., "Characterization of the highly discriminatory loci DYS449, DYS481, DYS518, DYS612, DYS626, DYS644 and DYS710", *Forensic Science International: Genetics*, vol. 4, No. 2, Feb. 1, 2010, 104-110.
Decker et al., "Evaluation of Additional Y-STR Loci to Resolve Common Haplotypes", *National Institute of Standards and Technology*, Oct. 2006, 1 Page.
Decker et al., "The impact of additional Y-STR loci on resolving common haplotypes and closely related individuals", *Forensic Science International : Genetics*, vol. 1, No. 2, Jun. 2007, 215-217.
Ehler et al., "Evaluation of 14 Y-chromosomal short tandem repeat haplotype with focus on DYS449, DYS456, and DYS458: Czech population sample." *Croatian Medical Journal*, 2010, vol. 51, No. 1, 54-60.
EP10816211.6, Extended Search Report, datedJun. 28, 2013, 1-8.
EP18168961.3, Search Report, dated Oct. 25, 2018, 1-8.
Geppert et al., "The Y-chromosomal STRs DYS481, DYS570, DYS576 and DYS643", *Legal Medicine*, vol. 11, Supplemental 1, Apr. 2009, s109-s110.
Giese et al., "Fast Multiplexed Polymerase Chain Reaction for Conventional and Microfluidic Short Tandem Repeat Analysis", *Journal of Forensic Sciences*, vol. 54, No. 6, Nov. 2009, 1287-1296.
Goedbloed et al., "Comprehensive mutation analysis of 17 Y-chromosomal short tandem repeat polymorphisms included in the AmpFlSTR® Yfiler® PCR amplification kit", *International Journal of Legal Medicine*, vol. 123, No. 6, Nov. 2009, 471-482.
Goff et al., Diagnostic Y-STR Markers In Haplogroup G, *Journal of Genetic Genealogy*, vol. 2, No. 1, See Abstract, 2006, 12-17.
Hanson et al., "A Highly Discriminating 21 Locus Y-STR "Megaplex" System Designed to Augment the Minimal Haplotype Loci for Forensic Casework*", *Journal of Forensic Sciences*, vol. 49, No. 1, Jan. 2004, 1-12.
Hanson et al., "An Ultra-High Discrimination Y Chromosome Short Tandem Repeat Multiplex DNA Typing System", *PLoS One*, vol. 2, No. 8, e688, Aug. 2007, 1-14.
Hanson et al., "Testing and Evaluation of 43 "Noncore" Y Chromosome Markers for Forensic Casework Applications", *Journal of Forensic Sciences*, vol. 51, No. 6, Nov. 2006, 1298-1314.
Hedman et al., "Dissecting the Finnish male uniformity: The value of additional Y-STR loci", *Forensic Science International: Genetics*, vol. 5, No. 3, Apr. 2010, 199-201.
Jacobs et al., "Development and Evaluation of Multiplex Y-STR Assays for Application in Molecular Genealogy", *Forensic Science International: Genetics Supplement Series*, vol. 2, 2009, 57-59.
Kayser et al., Appendix to Kayser et al. "A Comprehensive Survey of Human Y-Chromosomal Microsatellites", downloaded at URL: http://download.cell.com/AJHG/mmcs/journals/0002-9297/PIIS0002929707628444.mmc1.txt, Downloaded Jul. 9, 2012.
Kayser et al., "Relating two deep-rooted pedigrees from Central Germany by high-resolution Y-STR haplotyping", *Forensic Science International: Genetics*, vol. 1, No. 2, Jun. 2007, 125-128.
Kayser et al., Appendix to Kayser et al. "A Comprehensive Survey of Human Y-Chromosomal Microsatellites", vol. 4 *Supplemental Material*, 2004, 1-15.
Kayser et al., "A Comprehensive Survey of Human Y-Chromosomal Microsatellites", *The American Journal of Human Genetics*, vol. 74, Jan. 1, 2004, 1183-1197.
Krenke et al., "Validation of male-specific, 12-locus fluorescent short tandem repeat (STR) multiplex [Forensic Sci. Int. 148 (1) (2005) 1-14]", *Forensic Science International*, vol. 151, No. 1, Jun. 30, 2005, 111-124.
Leat et al., "Developments in the use of Y-chromosome markers in forensic genetics", *African Journal of Biotechnology*, vol. 3, No. 12, Dec. 2004, 637-642.
Leat et al., "Properties of novel and widely studied Y-STR loci in three South African populations." *Forensic Science International*, 2007, vol. 168, Nos. 2-3, 154-161.
Lim et al., "Variation of 52 New Y-STR Loci in the Y Chromosome Consortium Worldwide Panel of 76 Diverse Individuals", *International Journal of Legal Medicine*, vol. 121, No. 2, Mar. 2007, 124-127.
Martín et al., "A Spanish population study of 17 Y-chromosome STR loci." *Forensic Science International*, 2004, vol. 139, Nos. 2-3, 231-235.
Maybruck et al., "A Comparative Analysis of Two Different Sets of Y-Chromosome Short Tandem Repeats (Y-STRs) on a Common Population Panel", *Forensic Science International: Genetics*, vol. 4, 2009, 11-20.
Moreau, "Genetic heterogeneity in regional populations of Quebec-Parental lineages in the Gaspe Peninsula", *American Journal of Physical Anthropology*, vol. 139, Issue 4, Feb. 18, 2009, 512-522.
Mulero et al., "Development and Validation of the AmpFlSTR Yfiler PCR Amplification Kit: A Male Specific, Single Amplificatin 17 Y-STR Multiplex System", *Journal of Forensic Sciences*, vol. 51, No. 1, Jan. 2006, 64-75.
Palha et al. Fourteen short tandem repeat loci Y chromosome haplotypes: Genetic analysis in populations from northern Brazil. *Forensic Science International:Genetics*, vol. 6, 2012, 413-418.
Park et al., « Forensic Evaluation and Haplotypes of 19 Y-Chromosomal STR Loci in Koreans », *Forensic Science International*, vol. 152, 2005, 133-147.
PCT/US2010/048542, International Search Report & Written Opinion, dated May 30, 2011, 1-9.
PCT/US2010/048542, International Preliminary Report on Patentability, dated Mar. 13, 2012, 1-5.
PCT/US2013/031562, International Search Report and Written Opinion, dated Mar. 19, 2015, 1-8.
PCT/US2013/031562, International Search Report and Written Opinion, dated Oct. 2, 2013, 1-6.
Promega, "PowerPlex® Y23 System", Technical Manual, Instructions for Use of Product DC2305 and D2320, Jul. 2012, 1-75.
Qi et al. Analysis of genetic polymorphism of four Y-STR loci of Han people in Henan province, *Journal of Xinxiang Medical College*, Apr. 2007 [English Translation of Abstract Only].
Rębała et al., Polish population study on Y chromosome haplotypes defined by 18 STR loci. *International Journal of Legal Medicine*, 2005, 119(5):303-305.
Rębała et al. Forensic analysis of polymorphism and regional stratification of Y-chromosomal microsatellites in Belarus. *Forensic Science International*, 2011, Genetics 5(1):e17-e20.
Redd et al., "Forensic Value of 14 Novel STRs on the Human Y Chromosome", *Forensic Science International*, vol. 130, 2002, 97-111.
Rodig et al., "Evaluation of Haplotype Discrimination Capacity of 35 Y-Chromosomal Short Tandem Repeat Loci", *Forensic Science International*, vol. 174, 2008, 182-188.
Schoske, et al., High-throughput Y-STR typing of U.S. populations with 27 regions of the Y chromosome using two multiplex PCR assays. *Forensic Science International*, 2004, 139(2-3):107-121.
Shen et al., Seven new Y-STRs haplotypes of Chinese Han ethnic group. Forensic Science International, 2005, 154(1):81-84.
Shi et al., "An Analysis on Genetic Polymorphism and Genetic Relationship of 22 Y-STR loci in the Han People in Guangdong", *Hereditas*, vol. 30, No. 9, 2008, 1136-1142.
Shi, et al. Haplotypes of 20 Y-chromosomal STRs in a population sample from southeast China (Chaoshan area). *International Journal of Legal Medicine*, 2007, 121(6):455-462.

(56) References Cited

OTHER PUBLICATIONS

Shin, et al. Y-Chromosome multiplexes and their potential for the DNA profiling of Koreans. *International Journal of Legal Medicine*, 2001, 115(2):109-117.

Sinha et al., "Utility of the Y-STR Typing Systems Y-PLEX 6 and Y-PLEX 5 in Forensic Casework and 11 Y-STR Haplotype Database for Three Major Population Groups in the United States", *Journal of Forensic Science*, vol. 49, No. 4, Jul. 2004, 1-10.

Stratagene Catalog, "Stragagene Cloning Systems: Tools and Technology for Life Sciences", *Gene Characterization Kits*, Jan. 1, 1988, 39.

Tang, et al. Characterization of eight Y-STR loci and haplotypes in a Chinese Han population. *International Journal of Legal Medicine*, 2003, 117(5):263-270.

Vermeulen et al., "Improving global and regional resolution of male lineage differentiation by simple single-copy Y-chromosomal short tandem repeat polymorphisms", *Forensic Science International: Genetics*, vol. 3, No. 4, Sep. 2009, 205-213.

Von Wurmb-Schwark et al., "Possible pitfalls in motherless paternity analysis with related putative fathers", *Forensic Science International*, vol. 159, Nos. 2-3, Jun. 2, 2006, 92-97.

Wu, et al. Multiplex DNA typing of short tandem repeat loci on Y chromosome of Chinese population in Taiwan. *Forensic Science International*, 2001, 120(3):213-222.

Xu, et al. Diversity of five novel Y-STR loci and their application in studies of north Chinese populations. *Journal of Genetics*, 2010, 89(1):29-36.

Zarrabeitia, et al. Spanish population data and forensic usefulness of a novel Y-STR set (DYS437, DYS438, DYS439, DYS460, DYS461, GATA A10, GATA C4, GATA H4). *International Journal of Legal Medicine*, 2003, 117(5):306-311.

Zhang et al., Population genetics for Y-chromosomal STRs haplotypes of Chinese Korean ethnic group in northeastern China. *Forensic Science International*, 2007, 173(2-3):197-203.

Final Office Action cited in U.S. Appl. No. 16/799,810 dated Feb. 17, 2022.

Hammer et al. (Forensic Applications of Y Chromosome STRs and SNPs, 2000-IJ-CX-K006 Cumulative Technical Report, Jan. 2006, p. 1-51) (Year: 2006).

\* cited by examiner

FIGURE 5A

| GBD ID | Repeat Structure (as defined in Methods and Materials) | Bayesian median mutation rate | Bayesian 95% credible interval | Gains/ Losses | Total Mutations | Total Meioses | Primer 1 Sequence 5'–3' | Primer 2 Sequence 5'–3' | Ta in °C | Multi-plex | Ref |
|---|---|---|---|---|---|---|---|---|---|---|---|
| DYF380S1 | (AAT)8-11 | 3.84×10⁻⁴ | 1.42×10⁻⁵ – 2.06×10⁻³ | 0/0 | 0 | 1790 | AGCCATGTGGAT TCACCACT | GACAACCATCC TGTCTCC | TD 70-50 | 28 | [29] |
| DYF381S1 | (TTG)7-8 | 3.95×10⁻⁴ | 1.43×10⁻⁵ – 2.07×10⁻³ | 0/0 | 0 | 1774 | TCCATCCATCAA TCCATCAA | CAACCCAAACACT TGCAGAA | TD 60-50 | 45 | [29] |
| DYF381S2 | (AAC)7-9 | 3.91×10⁻⁴ | 1.44×10⁻⁵ – 2.11×10⁻³ | 0/0 | 0 | 1758 | CAACCCAAACA CTTGCAGAA | TCCATCCATCAAT CCATCAA | TD 60-50 | 20 | [29] |
| DYF382S1 | (GGAT)9-18(AGAT)1(GGAT)3N8(GGAC)3 | 1.65×10⁻³ | 1.52×10⁻⁴ – 3.47×10⁻³ | 1/0 | 1 | 1609 | TTGTAAAATGCG CATGTTGG | CCCAAAGTGCTAC CCACCTA | TD 60-50 | 54 | [29] |
| DYF383S1 | (AAT)7-16 | 6.82×10⁻³ | 3.10×10⁻³ – 1.04×10⁻² | 3/7 | 10 | 1772 | GACTGGTCAACT GCACTCCA | CCAATGTTACTCA CTATGCTGCTT | TD 70-50 | 29 | [29] |
| DYF388S1 | (CTTC)6(CTT)8-19N46(CTTC)3(TTTC)1 (CTTC)3N8(CTTC)2N2(CTTC)3 | 9.83×10⁻³ | 3.64×10⁻³ – 1.15×10⁻² | 5/6 | 11 | 1702 | TTCTAGGAAGAT TAGCCAACAG | CCCAGACAACAG AGCAAAAC | TD 65-50 | 52 | [29] |
| DYF389S1 | (TTTA)19-14 | 9.95×10⁻⁴ | 1.42×10⁻⁴ – 3.33×10⁻³ | 0/1 | 1 | 1680 | AGGATTCCCTTT CTCATTGC | TGGAGCTAGTG GGTGCAG | TD 70-50 | 12 | [29] |
| DYF389S2 | (AAG)4(AA)1(AAG)6-38(CAG)1-2 | 8.57×10⁻³ | 4.91×10⁻³ – 1.57×10⁻² | 9/5 | 14 | 1712 | GCAACCAAAAG GTTTGGAGA | GTGGAGCTGCTT AAAGAA | TD 70-50 | 31 | [29] |
| DYF394S1 | (ATT)3(GTT)1(ATT)6-9 | 3.91×10⁻⁴ | 1.40×10⁻⁵ – 2.06×10⁻³ | 0/0 | 0 | 1768 | CCCCTGAACA AATCTGGAG | GCAGTGAGCTGAG ATGGTGA | TD 70-50 | 24 | [29] |
| DYF395S1 | (TCT)6-9 | 9.86×10⁻⁴ | 1.37×10⁻⁴ – 2.06×10⁻³ | 0/0 | 0 | 1735 | TGCACGTCTTCA TACATAGAGC | TTGAATGCCAAGC TATGTAGCA | TD 70-50 | 36 | [29] |
| DYF401S1 | (AAGG)3(AAGG)1(AAGG)3N3(AAGG)1(AAGG)3N3 (AAGG)3(AAGG)1(AAGG)3N13 (AAGG)6-23 G4AGG)6 | 6.50×10⁻³ | 3.66×10⁻³ – 1.16×10⁻² | 3/5 | 8 | 1333 | TGCAAACATA GCACTTCAG | TTCTAGGAAGATT AGCCAACACA | TD 70-50 | 48 | [29] |

FIGURE 5A (con't)

| OBD ID | Repeat Structure (as defined in Methods and Materials) | Bayesian median mutation rate | Bayesian 95% credible interval | Gains/ Losses | Total Mutations | Total Meioses | Primer 1 Sequence 5'→3' | Primer 2 Sequence 5'→3' | Ta in °C | Multi-plex | Ref |
|---|---|---|---|---|---|---|---|---|---|---|---|
| DYF405S1 | (TGGAA)₄.₁₄N₁₁₅(GGAA)₃(GAAA)₁(GGAA)₃ | 1.52 x10⁻³ | 3.54 x10⁻⁴ – 4.12x10⁻³ | 1/1 | 2 | 1756 | CCGTCGTCTG AAGCATAG | CACATGAAGTTGG CTGTTTCA | TD 70-50 | 26 | [29] |
| DYF406S1 | (TATC)₈₋₁₄ | 3.82 x10⁻³ | 1.81 x10⁻³ – 7.48x10⁻³ | 3/3 | 6 | 1744 | CCTGGGTGACA CAGTGAGACT | TCCACCAAAATTC CATGACA | TD 70-50 | 28 | [29] |
| DYF410S1 | (AAAT)₇₋₁₃ | 2.04 x10⁻³ | 4.82 x10⁻⁴ – 5.52x10⁻³ | 2/0 | 2 | 1699 | TGACCAGTTAGT GGGTGCAG | GCGGCTAGGGTAG AATCCAT | TD 70-50 | 46 | [29] |
| DYS19/ DYS394 | (TAGA)₃(TAGG)₁(TAGA)₆.₁₆ | 4.37 x10⁻³ | 1.93 x10⁻³ – 8.23x10⁻³ | 4/3 | 7 | 1755 | Yfiler | Yfiler | Yfiler | Yfiler | [29] |
| DYS385a | (AAGG)₄N₁₄(AAAG)₃N₁₃(AAAG)₃N₂₉(AAGG)₁₆₋₂₁(GAAA)₁₋₂₃ | 2.08 x10⁻³ | 5.24 x10⁻⁴ – 5.06x10⁻³ | 2/1 | 3 | 1762 | Yfiler | Yfiler | Yfiler | Yfiler | [29] |
| DYS385b | (AAGG)₁₄(AAAG)₃N₁₂(AAAG)₃N₂₉(AAGG)₁₆.₂₁(GAAA)₇.₂₃ | 4.14 x10⁻⁴ | 1.75 x10⁻⁵ – 8.00x10⁻³ | 5/3 | 8 | 1615 | Yfiler | Yfiler | Yfiler | Yfiler | [29] |
| DYS388 | (ATT)₈₋₁₅ | 4.25 x10⁻⁴ | 1.51 x10⁻⁵ – 2.26x10⁻³ | 0/0 | 0 | 1635 | GTGAGTTAGCCG TTTAGCGA | CAGAATCCAACCA CTGCG | TD 60-50 | 50 | [29] |
| DYS389I | TCTG)₃(TCTA)₆₋₁₄ | 4.51 x10⁻³ | 2.72 x10⁻³ – 9.74x10⁻³ | 4/5 | 8 | 1751 | Yfiler | Yfiler | Yfiler | Yfiler | [29] |
| DYS389II | (TCTG)₁₋₅(TCTA)₁₀₋₁₄N₂₈(TCTG)₃(TCTA)₆.₁₄ | 3.83 x10⁻³ | 1.81 x10⁻³ – 7.49x10⁻³ | 2/4 | 6 | 1743 | Yfiler | Yfiler | Yfiler | Yfiler | [29] |
| DYS390 | (TCTG)₈(TCTA)₈.₁₄(TCTG)₁(TCTG)₄ | 1.52 x10⁻³ | 3.52 x10⁻⁴ – 4.09x10⁻³ | 0/2 | 2 | 1753 | Yfiler | Yfiler | Yfiler | Yfiler | [29] |
| DYS391 | (TCTG)₃(TCTA)₈.₁₅ | 9.23 x10⁻⁴ | 1.26 x10⁻⁴ – 6.65x10⁻³ | 3/2 | 5 | 1759 | Yfiler | Yfiler | Yfiler | Yfiler | [29] |
| DYS392 | (TAT)₉₋₂₀ | 9.70 x10⁻⁴ | 1.43 x10⁻⁴ – 3.22x10⁻³ | 1/0 | 1 | 1728 | Yfiler | Yfiler | Yfiler | Yfiler | [29] |
| DYS393/ DYS395 | (AGAT)₇₋₁₈ | 2.11 x10⁻³ | 5.21 x10⁻⁴ – 5.09x10⁻³ | 2/1 | 3 | 1750 | Yfiler | Yfiler | Yfiler | Yfiler | [29] |
| DYS425/ DYF371 | (TGT)₈₋₁₄ | 1.51 x10⁻³ | 3.46 x10⁻⁴ – 4.08x10⁻³ | 1/1 | 2 | 1773 | TGGAGAGAGA AGAGAGAAAT | AGTAATTCTGGAG GTAAAATGG | TD 60-50 | 29 | [29] |
| DYS426 | (GTT)₉₋₁₂ | 3.96 x10⁻⁴ | 1.49 x10⁻⁵ – 2.11x10⁻³ | 0/0 | 0 | 1735 | CTCAAAGTATGA AAGCATGACCA | CGTGACAAGAACG AGACTTGTG | TD 70-50 | 33 | [29] |
| DYS434 | (ATCT)₉₋₁₂ | 4.94 x10⁻⁴ | 1.47 x10⁻⁵ – 2.14x10⁻³ | 0/0 | 0 | 1715 | CACTCCCTGAGT GCTCGATT | GGAGATGAATGA ATGGATGGA | TD 60-50 | 40 | [29] |
| DYS435 | (TGGA)₉₋₁₂ | 1.00 x10⁻³ | 1.47 x10⁻⁴ – 2.14x10⁻³ | 0/1 | 1 | 1676 | AGCATCTCCACA CAGCACAG | TTGTCTCTCCCCT CCTCTC | TD 60-50 | 41 | [29] |

FIGURE 5A (con't)

| GBD ID | Repeat Structure (as defined in Methods and Materials) | Bayesian median mutation rate | Bayesian 95% credible interval | Gains/ Losses | Total Mutations | Total Meioses | Primer 1 Sequence 5'→3' | Primer 2 Sequence 5'→3' | Ta in °C | Multi-plex | Ref |
|---|---|---|---|---|---|---|---|---|---|---|---|
| DYS436 | (GTT)11-13 | 3.84 x10$^{-4}$ | 1.33 x10$^{-5}$ – 2.05x10$^{-3}$ | 0/0 | 0 | 1793 | CCAGGAGAGCA CACACAAA | GCAATCCAACTTC AGCCAAT | TD 60-50 | 18 | [29] |
| DYS437 | (TCTA)4-12(TCTG)2(TCTA)4 | 1.52 x10$^{-3}$ | 3.54 x10$^{-4}$ – 4.15x10$^{-3}$ | 2/0 | 2 | 1760 | Yfiler | Yfiler | Yfiler | Yfiler | [29] |
| DYS438 | (TTTTC)7-16 | 3.56 x10$^{-4}$ | 1.37 x10$^{-5}$ – 3.18x10$^{-3}$ | 0/1 | 1 | 1751 | Yfiler | Yfiler | Yfiler | Yfiler | [29] |
| DYS439 | (GATA)8-15(GATA)8-19 | 3.84 x10$^{-3}$ | 1.63 x10$^{-3}$ – 7.54x10$^{-3}$ | 2/4 | 6 | 1736 | Yfiler | Yfiler | Yfiler | Yfiler | [45] |
| DYS441 | (TTCC)11-21.2 | 1.18 x10$^{-3}$ | 1.66 x10$^{-4}$ – 3.93x10$^{-3}$ | 1/0 | 1 | 1419 | ATGTACCTGTAG CCCAGTGAAC | AAGTTGCAGTGAG CGAAGATTC | TD 70-50 | 27 | [45] |
| DYS442 | (GATA)8-16(GACA)3 | 9.78 x10$^{-3}$ | 5.59 x10$^{-3}$ – 1.57x10$^{-2}$ | 2/12 | 14 | 1497 | AAACGCCATC AATCAATGAGT G | CCCAAGTCCCA AAGTGTGT | TD 70-60 | 16 | [45] |
| DYS443 | (TTCC)4-17(CTT)3 | 2.10 x10$^{-3}$ | 6.24 x10$^{-4}$ – 5.01x10$^{-3}$ | 2/1 | 3 | 1745 | GAGTTCATGCTG ATGACAAGC | TCATTGGCCACCT GACATTA | TD 70-50 | 29 | [29] |
| DYS444 | (TAGA)9-16 | 5.45 x10$^{-3}$ | 2.63 x10$^{-3}$ – 9.85x10$^{-3}$ | 3/6 | 9 | 1775 | TGTGAACCATTG GGCATGG | TCACGTGTTCAA GGGTGTT | TD 60-50 | 45 | [29] |
| DYS445 | (TTTA)6-14 | 2.16 x10$^{-3}$ | 6.38 x10$^{-4}$ – 5.15x10$^{-3}$ | 2/1 | 3 | 1764 | GAGCTGAGATT ATGCCACAAA A | AGTTAAGAGCCCC ACCTTCCTG | TD 70-50 | 32 | [45] |
| DYS446 | (TCTCT)8-21 | 2.67 x10$^{-3}$ | 8.38 x10$^{-4}$ – 5.87x10$^{-3}$ | 2/2 | 4 | 1747 | TATTTCAGTCT TGTCTGTC | AAATGTATGGCCA ACATAGCAAACC | TD 70-50 | 30 | [45] |
| DYS447 | (TAATA)3-7(TTATH)1(TTATA)8-13 (TATH)1(TTATA)6-9 | 2.12 x10$^{-3}$ | 1.41 x10$^{-3}$ – 5.11x10$^{-3}$ | 1/2 | 3 | 1722 | GGGCTTGCTTG CGTTATCT | CGTCAACAGCATG CTTGGTT | TD 70-50 | 27 | [45] |
| DYS448 | (AGAGAT)13-19N42(AGAGAT)8-9 | 3.94 x10$^{-4}$ | 8.36 x10$^{-5}$ – 2.11x10$^{-3}$ | 0/0 | 0 | 1747 | Yfiler | Yfiler | Yfiler | Yfiler | [45] |
| DYS450 | (TTTA)7-11N12(TTTA)3 | 1.04 x10$^{-3}$ | 1.54 x10$^{-4}$ – 3.50x10$^{-3}$ | 0/1 | 1 | 1588 | GGCTTCCAATT TCAATTTCTGA | TGGAATATGATGC AGCTGTTTGT | TD 70-50 | 39 | [45] |
| DYS452 | (TATAC)5-4(4(CATACH(TATAC)12-4 N0(CATAC)3(CATAC)(TATAC)3 | 4.02 x10$^{-3}$ | 1.56 x10$^{-3}$ – 8.28x10$^{-3}$ | 2/3 | 5 | 1411 | TTTATTATACTC AGCTAATTAATT GGTT | GTGGTGTTCTGAT GAGGATAAT | TD 70-50 | 16 | [45] |
| DYS453 | (AAAT)9-15 | 3.89 x10$^{-4}$ | 1.43 x10$^{-5}$ – 2.03x10$^{-3}$ | 0/0 | 0 | 1782 | GGGTAACAGAA CAAGACAGT | CTAAAGTATGGA TATTCTTCG | TD 60-50 | 45 | [45] |

FIGURE 5A (con't)

| GDB ID | Repeat Structure (as defined in Methods and Materials) | Bayesian median mutation rate | Bayesian 95% credible interval | Gains/ Losses | Total Mutations | Total Meioses | Primer 1 Sequence 5'→3' | Primer 2 Sequence 5'→3' | Ta in °C | Multi-plex | Ref |
|---|---|---|---|---|---|---|---|---|---|---|---|
| DYS454 | (AAAT)7-13 | $4.75 \times 10^{-4}$ | $1.71 \times 10^{-5}$ – $2.55 \times 10^{-3}$ | 0/0 | 0 | 1458 | TCACAATGACCCTTTTGTGC | GTTCTTTGACCCTGCATTTA | TD 60-50 | 46 | [29] |
| DYS455 | (ATT)8.2-11 | $4.26 \times 10^{-4}$ | $1.59 \times 10^{-5}$ – $2.28 \times 10^{-3}$ | 0/0 | 0 | 1513 | ATCTGAGCCGAGAGAATGATA | GGGGTGGAAACGAGTGTT | TD 70-50 | 39 | [45] |
| DYS456 | (AGAT)11-23 | $4.94 \times 10^{-3}$ | $2.35 \times 10^{-3}$ – $8.97 \times 10^{-3}$ | 6/2 | 8 | 1757 | Yfiler | Yfiler | Yfiler | Yfiler | [45] |
| DYS458 | (GAAA)11-24 | $8.36 \times 10^{-3}$ | $4.80 \times 10^{-3}$ – $1.34 \times 10^{-2}$ | 7/7 | 14 | 1756 | Yfiler | Yfiler | Yfiler | Yfiler | [45] |
| DYS459 | (ATT)8-11 | $2.67 \times 10^{-3}$ | $9.36 \times 10^{-4}$ – $5.86 \times 10^{-3}$ | 2/2 | 4 | 1741 | CAGGTGAACTGGGTAAATAAT | TTGAGCAACAGAGCAAGACTTA | TD 70-50 | 27 | [45] |
| DYS460 | (TAGA)8-13 | $6.22 \times 10^{-3}$ | $3.19 \times 10^{-3}$ – $1.07 \times 10^{-2}$ | 2/8 | 10 | 1717 | GCCAAACTCTTTCCAAGAAG | TCTATCCTCTGCCTATCATTATTA | TD 60-50 | 20 | [29] |
| DYS461 | (TAGA)8-13 | $9.89 \times 10^{-4}$ | $1.40 \times 10^{-4}$ – $3.29 \times 10^{-3}$ | 0/1 | 1 | 1695 | AGGCAGAGGATAGATAGATGGAAT | TTCAGGTAAATCTGTCCAGTAGTGA | TD 60-50 | 19 | [45] |
| DYS462 | (CATA)9-14 | $2.65 \times 10^{-3}$ | $9.20 \times 10^{-4}$ – $5.80 \times 10^{-3}$ | 2/2 | 4 | 1771 | TGTCTGTACCAGTTGCCTA | CCAGCCTGAGCAAGAGACTA | TD 70-50 | 30 | [45] |
| DYS463 | (AAAGG)6-7(AAGG)19-19 | $1.54 \times 10^{-3}$ | $3.49 \times 10^{-4}$ – $4.07 \times 10^{-3}$ | 2/0 | 2 | 1778 | AATTCTAGTTT | ATGAGGTGTGTG | TD | 33 | [45] |
| DYS464 | (CCT)9-28N46(CCT)3N35(CCT)4-18 (CTC)4 (CTT)7-9(ATTCAT)8-10 | $7.27 \times 10^{-3}$ | $3.96 \times 10^{-3}$ – $1.20 \times 10^{-2}$ | 5/7 | 12 | 1745 | GAGCAAAGACA | ACTGACTC | 70-50 | 31 | [45] |
| DYS468 | (CTT)3N39(CTT)4(GTT)1(CTT)8-30F (CTT)3 N17(CTT)5N37(CTT)4N12(CTT)4 M12(CTT)3N12(CTT)5(CCT)4N9(CTT)3 (CCT)3 | $1.74 \times 10^{-3}$ | $4.03 \times 10^{-4}$ – $4.69 \times 10^{-3}$ | 1/1 | 2 | 1535 | TTACGAGCTTTGGGCTATG | CCTGGGTAACACTGGAGACTCTT | TD 70-50 | 37 | [45] |
| DYS469 | | $2.99 \times 10^{-3}$ | $1.04 \times 10^{-3}$ – $6.54 \times 10^{-3}$ | 3/1 | 4 | 1555 | GGGAGTTCCAAACTTTTCACA | GGGGAAGATGACAATGATG | TD 70-50 | 41 | [29] |
| DYS470 | (GTT)8-12N33(GTT)3 | $4.20 \times 10^{-4}$ | $1.51 \times 10^{-5}$ – $2.23 \times 10^{-3}$ | 0/0 | 0 | 1651 | TTTGGGGACTGAATTCAAAA | CCCCAGCTGGTAAATGAGT | TD 60-50 | 44 | [29] |
| DYS472 | (AAT)7-9 | $4.46 \times 10^{-4}$ | $1.92 \times 10^{-5}$ – $2.37 \times 10^{-3}$ | 0/0 | 0 | 1549 | GGTCCTTCAGGAACCAGTTG | TGGCTGTAAACAAATATCAGGA | TD 70-50 | 1 | [29] |
| DYS473 | (AAT)8N12(AAT)8-13 | $4.13 \times 10^{-4}$ | $1.47 \times 10^{-5}$ – $2.21 \times 10^{-3}$ | 0/0 | 0 | 1678 | AGATTGTCCCACCTGCACTC | GAGGCAGTGTGTTCAGCAAA | TD 60-50 | 44 | [29] |

FIGURE 5A (con't)

| GBD ID | Repeat Structure (as defined in Methods and Materials) | Bayesian median mutation rate | Bayesian 95% credible interval | Gains/ Losses | Total Mutations | Total Meioses | Primer 1 Sequence 5'-3' | Primer 2 Sequence 5'-3' | Ta in °C | Multi-plex | Ref |
|---|---|---|---|---|---|---|---|---|---|---|---|
| DYS474 | (AAC)9-10 | 3.92 x10$^{-4}$ | 1.41 x10$^{-5}$ – 2.08x10$^{-3}$ | 0/0 | 0 | 1766 | CCCTGAACTTA AAAGGTGGA | GGCATGTAGGTTT ACTGTGAGA | TD 60-50 | 22 | [29] |
| DYS475 | (TAA)7-9(CAA)1(TAA)3 | 4.14 x10$^{-4}$ | 1.54 x10$^{-5}$ – 2.21x10$^{-3}$ | 0/0 | 0 | 1681 | GCCAAGGGG TTTTCAGA | CCCACAGAAAGAT GTTGAGG | TD 60-50 | 23 | [29] |
| DYS476 | (TGA)7-13 | 9.40 x10$^{-4}$ | 1.35 x10$^{-4}$ – 3.12x10$^{-3}$ | 1/0 | 1 | 1779 | CGACTATCATTT GGCTGTG | AGCTGGGAAGTAC TCAATGCTC | TD 70-50 | 7 | [29] |
| DYS477 | (TTG)8-9 | 3.91 x10$^{-4}$ | 1.37 x10$^{-5}$ – 2.07x10$^{-3}$ | 0/0 | 0 | 1765 | TAAGTTACAGAA AAGCTCAGGG | AAGTGAATCGAGT GCCTAGC | TD 60-50 | 42 | [29] |
| DYS478 | (CAG)4(CAA)1(CAG)3 | 4.04 x10$^{-4}$ | 1.46 x10$^{-5}$ – 2.17x10$^{-3}$ | 0/0 | 0 | 1718 | ACAGGCAACAA ATTGGGTA | TCAGGATAAGCTA GCAGTCTATG | TD 60-50 | 20 | [29] |
| DYS480 | (TTA)9-10 | 3.91 x10$^{-4}$ | 1.44 x10$^{-5}$ – 2.09x10$^{-3}$ | 0/0 | 0 | 1763 | CCAGCACCTAG GTTGAGGTA | CAGCACTTCAAAA TGACAGA | TD 70-50 | 9 | [29] |
| DYS481 | (CT)22-32 | 4.87 x10$^{-3}$ | 2.36 x10$^{-3}$ – 9.80x10$^{-3}$ | 3/5 | 8 | 1744 | AGGAATGTGGC TAACGTGT | ACAGCTCACCAGA AGGTTGC | TD 70-50 | 12 | [29] |
| DYS484 | (AAT)9-18N10(AAT)3(TAT)3 | 2.61 x10$^{-3}$ | 9.09 x10$^{-4}$ – 5.73x10$^{-3}$ | 2/2 | 4 | 1792 | CCTATCATCCGC ATGGACTT | CCTGGTTGACAAA GCCACAT | TD 60-50 | 21 | [29] |
| DYS485 | (TTT)8-11(TTA)11-21 | 4.04 x10$^{-4}$ | 1.53 x10$^{-5}$ – 2.13x10$^{-3}$ | 0/0 | 0 | 1730 | AAAGCAGACTT CCCACTACA | AAAATTAGCTGG GCCTGT | TD 70-50 | 9 | [29] |
| DYS487 | (AAT)19-16 | 1.77 x10$^{-3}$ | 4.08 x10$^{-4}$ – 4.78x10$^{-3}$ | 1/1 | 2 | 1511 | TGTGGGAGGCCT TAAGAAAA | CCTGGGCAACAGA GAAAGAC | TD 70-50 | 1 | [29] |
| DYS488 | (ATA)15-16 | 4.40 x10$^{-4}$ | 1.60 x10$^{-5}$ – 2.32x10$^{-3}$ | 0/0 | 0 | 1576 | GGGGAGGGATA GCATTAGGA | TACCCTGGTCCAC TTCAACC | TD 70-50 | 3 | [29] |
| DYS489 | (TTA)10-15 | 4.43 x10$^{-4}$ | 1.66 x10$^{-5}$ – 2.28x10$^{-3}$ | 0/0 | 0 | 1562 | ACCCAAAGATTT GTCGGGTA | AAAATTAGCCGAG CATGGTG | TD 70-50 | 37 | [29] |
| DYS490 | (TTA)8-16 | 4.19 x10$^{-4}$ | 1.48 x10$^{-5}$ – 2.19x10$^{-3}$ | 0/0 | 0 | 1759 | CCTGCAGGAA TTATCAGA | GCAGAGCTTGCAC TGAGCT | TD 70-50 | 10 | [29] |
| DYS491 | (ATA)9-14 | 4.09 x10$^{-4}$ | 1.45 x10$^{-5}$ – 2.17x10$^{-3}$ | 0/0 | 0 | 1706 | GGAATGGGAG GCATAACAT | GGAGAAAATTCA ATGCAGATACC | TD 70-50 | 15 | [29] |
| DYS492 | (ATA)9-15 | 3.92 x10$^{-4}$ | 1.45 x10$^{-5}$ – 2.09x10$^{-3}$ | 0/0 | 0 | 1770 | AGATGAGCCAG GCTTCAGAC | AGTAGGGGTCAG GCACAATG | TD 70-50 | 7 | [29] |
| DYS493 | (AAC)9-11 | 3.85 x10$^{-4}$ | 1.45 x10$^{-5}$ – 2.08x10$^{-3}$ | 0/0 | 0 | 1680 | ACTCCAGTCTGG GTGGACAG | CCCTGGGATTATA GGCATGA | TD 70-50 | 38 | [29] |
| DYS494 | (TA)4-6(TAA)17-41 | 3.89 x10$^{-4}$ | 1.43 x10$^{-5}$ – 2.06x10$^{-3}$ | 0/0 | 0 | 1783 | TTGCAACACTGT TCATTTGGA | AACAAACCTGCAT GTTCTTCAA | TD 70-50 | 11 | [29] |

FIGURE 5A (con't)

| GBD ID | Repeat Structure (as defined in Methods and Materials) | Bayesian median mutation rate | Bayesian 95% credible interval | Gains/ Losses | Total Mutations | Total Meioses | Primer 1 Sequence 5'-3' | Primer 2 Sequence 5'-3' | Ta in °C | Multi plex | Ref |
|---|---|---|---|---|---|---|---|---|---|---|---|
| | | | 2.07x10⁻⁵ – | | | | | | | | |
| DYS495 | (AAT)12-19 | 2.09 x10⁻³ | 6.19 x10⁻⁴ – 4.97x10⁻³ | 2/1 | 3 | 1755 | CCCAGTATTCA GGAGGTTG | GCCAGAAAGTGTG AGTCATCC | TD 70-50 | 10 | [29] |
| DYS497 | (TTA)18-16 | 1.49 x10⁻⁴ | 3.46 x10⁻⁴ – 4.05x10⁻³ | 1/1 | 2 | 1796 | AACATGTGCGTT TTCAACCA | GCATGTGTGCAC ATGTAACC | TD 70-60 | 13 | [29] |
| DYS499 | (TTG)8 | 3.93 x10⁻⁴ | 1.40 x10⁻⁵ – 2.09x10⁻³ | 0/0 | 0 | 1771 | TGGGTCAGGAGA AAGGATTGC | GGAGGAAGAGGT TGCAATGA | TD 70-50 | 47 | [29] |
| DYS502 | (AATA)4TGCN(CATA)6-9 | 3.85 x10⁻⁴ | 1.43 x10⁻⁵ – 2.05x10⁻³ | 0/0 | 0 | 1782 | CAGCAAGCCAC CATACCATA | TGTGCTTTTGGAG TTTGGAG | TD 70-50 | 34 | [29] |
| DYS504 | (CCTT)8-20N7(CCCT)3 | 3.24 x10⁻³ | 1.26 x10⁻³ – 6.52x10⁻³ | 1/4 | 5 | 1748 | TCTACAGCAATG TGCCAAGG | GGCAACAGAGCA ACCCTCT | TD 70-50 | 8 | [29] |
| DYS505 | (TCC)19-18 | 1.51 x10⁻³ | 3.50 x10⁻⁴ – 4.07x10⁻³ | 1/1 | 2 | 1760 | TCTGGCGAAGTA ACCCAAAC | TCGAGTCAGTTCA CCAGAGG | TD 70-60 | 6 | [29] |
| DYS508 | (TATC)8-15 | 3.03 x10⁻³ | 1.05 x10⁻³ – 6.68x10⁻³ | 2/2 | 4 | 1544 | ACAATGGCAAT CCCAAATC | GAACAAATAAGG TGGATGGAT | TD 70-50 | 1 | [29] |
| DYS509 | (AAATA)3N12(GATA)8-15N12(GGAT)4 No(GATA)3 | 1.06 x10⁻³ | 1.55 x10⁻⁴ – 3.53x10⁻³ | 0/1 | 1 | 1590 | AACAGGTGAA TCCCTGTCTCT | TGTCCCAGGGGT TTTTAAT | TD 70-50 | 37 | [29] |
| DYS510 | (GATA)3N12(GATA)8-15N12(GGAT)4 No(GATA)3 | 5.99 x10⁻³ | 3.09 x10⁻³ – 1.03x10⁻² | 4/6 | 10 | 1779 | TTTTTCCTCCTT ACCAGAGA | TCTGAGAAGACA GAACTTGTCA | TD 70-50 | 34 | [29] |
| DYS511 | (GATA)8-14 | 1.52 x10⁻³ | 3.51 x10⁻⁴ – 4.11x10⁻³ | 1/1 | 2 | 1760 | GATAGGATGGG GTGGATGTG | TGTGAATTCCCT TCTACATCTG | TD 70-50 | 13 | [29] |
| DYS512 | (AGA)7-13 | 3.95 x10⁻⁴ | 1.44 x10⁻⁵ – 2.11x10⁻³ | 0/0 | 0 | 1738 | CACGCCCAGCT AATTTTTGT | GGGAGGAATAAA GGAAGGTTG | TD 70-50 | 28 | [29] |
| DYS513 | (TCTA)4(TCCA)1(TATC)6(CGTA)1 (TCTA)9-15 | 6.09 x10⁻³ | 3.14 x10⁻³ – 1.05x10⁻² | 6/4 | 10 | 1751 | ATTGATCCATCC GTCTGTC | GTTGGATGAAGGG AGAGCAG | TD 70-50 | 32 | [29] |
| DYS516 | (TTCT)4N3(TTC)19-18 | 6.60 x10⁻³ | 3.55 x10⁻³ – 1.12x10⁻² | 7/4 | 11 | 1753 | TTTCCAATGAGC AAGACGTG | CGAACTCGCAAAT TGTTCAC | TD 60-50 | 22 | [29] |
| DYS517 | (AAAG)18-18N3(AAAG)2 | 3.21 x10⁻³ | 1.25 x10⁻³ – 6.62x10⁻³ | 3/2 | 5 | 1766 | TAATGTCCCAT TTTGAGCA | TGCAATCCCAAAT TCAGAGA | TD 60-50 | 22 | [29] |
| DYS520 | (GATA)10-13(CATA)10-11 | 2.66 x10⁻³ | 9.22 x10⁻⁴ – 5.89x10⁻³ | 2/2 | 4 | 1760 | AACAGGCTGCC CAACATAGT | ACCATCATGCCCT GCAATA | TD 70-50 | 24 | [29] |

FIGURE 5A [con't]

| GBD ID | Repeat Structure (as defined in Methods and Materials) | Bayesian median mutation rate | Bayesian 95% credible interval | Gains/Losses | Total Mutations | Total Meioses | Primer 1 Sequence 5'-3' | Primer 2 Sequence 5'-3' | Ta in °C | Multi-plex | Ref |
|---|---|---|---|---|---|---|---|---|---|---|---|
| DYS521 | (CTTT)3-6(TT)3(TTT)1(CTTT)3T (CTT)4-14 | 9.54×10⁻⁴ | 1.37×10⁻⁴ – 3.18×10⁻³ | 0/1 | 1 | 1751 | GCCAGAGCACC TGTTCAGTA | GCTGGGAGTGAG ACCCTGTA | TD 70-50 | 24 | [29] |
| DYS522 | (ATAG)8-15 | 1.64×10⁻³ | 1.53×10⁻³ – 3.44×10⁻³ | 1/0 | 1 | 1820 | CCTTTGAAATCA TTCATAATGC | TCATAAACAGAGG GTTCTGG | TD 70-50 | 4 | [29] |
| DYS525 | (AGAT)8-13 | 9.78×10⁻⁴ | 1.42×10⁻⁴ – 3.26×10⁻³ | 0/1 | 1 | 1712 | ATTCAGACCATT GCACTCCA | CCATGTTTATG TTCCCATCA | TD 70-50 | 2 | [29] |
| DYS526a | (CCTT)10-17 | 2.72×10⁻³ | 9.52×10⁻⁴ – 5.97×10⁻³ | 2/2 | 4 | 1716 | TGTCGTGAACTG ATCCAAACC | GGGTTACTTCGCC AGAAGGT | TD 65-50 | 51 | [29] |
| DYS530 | (AAAC)8-11 | 3.94×10⁻⁴ | 1.45×10⁻⁵ – 2.10×10⁻³ | 0/0 | 0 | 1760 | CAGGGTCAAAA TCACCTTCC | CTGCGGGACAATG AAACAC | TD 70-50 | 15 | [29] |
| DYS531 | (AAAT)8-13 | 1.60×10⁻³ | 1.45×10⁻⁴ – 3.50×10⁻³ | 0/1 | 1 | 1682 | GACCCACTGGC ATTCAAATC | TGGTCCTTTCTT GTAGAGG | TD 70-50 | 3 | [29] |
| DYS532 | [TCC(TT)3-4(TCC)3N4(TTCC)3N13(TTCC)4N70(TTCT)3 N6(TTCT)3 | 3.24×10⁻³ | 1.43×10⁻³ – 7.10×10⁻³ | 3/1 | 4 | 1441 | TTGTTTTATGC CTTTCAGT | YAGGTGACAGAGC AGGATTC | TD 70-50 | 39 | [29] |
| DYS533 | (TATC)8-14 | 5.01×10⁻³ | 2.39×10⁻³ – 9.11×10⁻³ | 4/4 | 8 | 1730 | CATCTAACATCT TTGTCATCTACC | TGATCAGTTCTTA ACTGAACCA | TD 70-50 | 5 | [29] |
| DYS534 | (CTTT)3N6(CTTT)3-26M6(CTTT)3 | 6.51×10⁻³ | 3.44×10⁻³ – 1.19×10⁻² | 9/2 | 11 | 1794 | CATCTACCCAAC ATCATCTA | GACAAAGATGTTA GATGAATAGACA | TD 60-50 | 18 | [29] |
| DYS536 | (TCCT)9-10N6(TTTCT)4 | 1.15×10⁻³ | 1.68×10⁻⁴ – 3.83×10⁻³ | 1/0 | 1 | 1453 | TTGCTTTTCTGC TTCCCTTC | ATCGCATTCCCCT CTCCTAC | TD 52 | 53 | [29] |
| DYS537 | (TCTA)8-13 | 2.38×10⁻³ | 7.12×10⁻⁴ – 5.76×10⁻³ | 2/1 | 3 | 1539 | GGTCCCAATTC CATCCAGA | TGGAACATGCCCA TTAATCA | TD 70-50 | 3 | [29] |
| DYS538 | (GATA)8-13 | 3.54×10⁻⁴ | 1.47×10⁻⁵ – 2.10×10⁻³ | 0/0 | 0 | 1765 | CCCCTGAATCAC CAGAGTTC | AACCAGCCCAAAT ACCATC | TD 70-50 | 31 | [29] |
| DYS539 | (TAGA)8-14 | 1.69×10⁻³ | 1.46×10⁻⁴ – 3.32×10⁻³ | 0/1 | 1 | 1675 | GTTGAAGCCCTC AATCGGT | GGTGCAGATCGTC CAAATTC | TD 60-50 | 19 | [29] |
| DYS540 | (TTA)9-14 | 3.30×10⁻³ | 1.28×10⁻³ – 6.79×10⁻³ | 2/3 | 5 | 1713 | GACCGTGTACTC TGGCAAT | CAGGAGGCTAGCT CAGGAGA | TD 70-50 | 7 | [29] |
| DYS541 | (TATC)10-16(TTC)1(TATC)3 | 3.82×10⁻³ | 1.65×10⁻³ – 7.66×10⁻³ | 2/4 | 6 | 1760 | TTCTATCTGTTC ATCCATCTAGG | ACCTTTAAGAAGC CTTCACC | TD 60-50 | 20 | [29] |

FIGURE 5A [con't]

| GBD ID | Repeat Structure (as defined in Methods and Materials) | Bayesian median mutation rate | Bayesian 95% credible interval | Gains/ Losses | Total Mutations | Total Meioses | Primer 1 Sequence 5'→3' | Primer 2 Sequence 5'→3' | Ta in °C | Multi plex | Ref |
|---|---|---|---|---|---|---|---|---|---|---|---|
| DYS543 | (AGAT)3(GATA)7-18N42 (ATGT)3-4 (ATGG)2-3N35(GAAA)3 | 7.10 x10⁻³ | 3.77 x10⁻³ – 3.52x10⁻³ | 4/7 | 11 | 1645 | CAAGGGCAAT TATGTATGT | TGATCTCCTGGT CACTTTT | TD 60-50 | 23 | [29] |
| DYS544 | (TAGA)5N15(TAGA)3(TGGA)1(TAGA)6-12 | 3.96 x10⁻⁴ | 1.44 x10⁻⁵ – 1.20x10⁻³ | 0/0 | 0 | 1748 | CTGGGCAAGAG AGCAAGATT | AATGCTGGCCAAA ACAAAGT | TD 70-50 | 32 | [29] |
| DYS545 | (TGTT)8-11 | 3.90 x10⁻⁴ | 1.39 x10⁻⁵ – 2.09x10⁻³ | 0/0 | 0 | 1779 | GAGGGGAACTGT AGAAGAATGG | GATCCAAGATGGT GCCATTG | TD 70-50 | 30 | [29] |
| DYS546 | (TTCC)3N23(TTCT)3N3(TTCC)3N15 (TTCT)9-19 | 4.35 x10⁻³ | 1.85 x10⁻³ – 8.55x10⁻³ | 2/4 | 6 | 1531 | CCTGAGCTATTT TCCCTTTCC | TGCAGTACATCCT GGGAAT | TD 70-50 | 35 | [29] |
| DYS549 | (GATA)9-15 | 4.55 x10⁻³ | 2.05 x10⁻³ – 8.58x10⁻³ | 1/6 | 7 | 1634 | AACCAAATTCA GGGATGTACTC A | GTCCCTTTTCCA TTTGTGA | TD 70-50 | 15 | [29] |
| DYS550 | (AAGG)4N16(AGAG)4(AAAG)1 (AAGG)8-11 | 3.87 x10⁻⁴ | 1.41 x10⁻⁵ – 2.06x10⁻³ | 0/0 | 0 | 1794 | GCCTGGGTAAC AGGAGTGAA | AGCTGAAAACTGT GCTGCTG | TD 70-50 | 34 | [29] |
| DYS551 | (AGAT)10-15N6(AGAC)3(AGGT)1(AGAT)4 | 3.26 x10⁻³ | 1.26 x10⁻³ – 6.72x10⁻³ | 1/4 | 5 | 1737 | CCAGCTGGGT GACAAAGTA | AAAGTTCCTCCCA GTTGCAC | TD 70-50 | 38 | [29] |
| DYS552 | (TCTA)3(TCTG)1(TCTA)7-12N40 (TGTA)11-16 | 2.69 x10⁻³ | 9.21 x10⁻⁴ – 5.87x10⁻³ | 3/1 | 4 | 1742 | CCATAGTGCCG AGTCAAGT | AACACCTGATGCC TCGTTG | TD 70-50 | 36 | [29] |
| DYS554 | (TAAA)9-11 | 9.41 x10⁻⁴ | 1.36 x10⁻⁴ – 3.15x10⁻³ | 1/0 | 1 | 1777 | CTGGGCCAACAG AGTGAGAG | GGGCCAGTCTTTG CAATATC | TD 70-50 | 13 | [29] |
| DYS556 | (AAAT)9-12 | 1.59 x10⁻³ | 3.70 x10⁻⁴ – 4.30x10⁻³ | 1/1 | 2 | 1633 | TGCTGTCACATC ACCAATGA | TTTGGTTGCTGAA GCATTGA | TD 70-50 | 14 | [29] |
| DYS557 | (TTTG)4(TTCT)2(TTCG)1(TTCA)1(TTCT)1 (TTCT)12-21 | 3.80 x10⁻³ | 1.60 x10⁻³ – 7.45x10⁻³ | 3/3 | 6 | 1756 | TTTCTGTGCCA AGCCTACA | TCTAATGCACCTT GAGGGATG | TD 60-50 | 21 | [29] |
| DYS558 | (TTTG)4(TTTA)8-19 | 3.98 x10⁻⁴ | 1.42 x10⁻⁵ – 2.13x10⁻³ | 0/0 | 0 | 1741 | GGTGGTCAGAA AATCCTCA | CCAAGGCCAATATT CACCAT | TD 70-50 | 26 | [29] |
| DYS559 | (TAAA)7-9 | 9.63 x10⁻⁴ | 1.40 x10⁻⁴ – 3.19x10⁻³ | 1/0 | 1 | 1750 | AGCCAAGGTCA TACCACTGC | TCGGTGAAGGCAC CAATAAT | TD 70-50 | 25 | [29] |
| DYS561 | (GATA)9-13(GACA)4 | 9.41 x10⁻⁴ | 1.36 x10⁻⁴ – 3.11x10⁻³ | 0/1 | 1 | 1783 | GCCTGATGCCAT CTGAAAT | TGATCCAAGAAC TGCACTC | TD 60-50 | 17 | [29] |
| DYS562 | (ATAA)9-14 | 2.09 x10⁻³ | 6.20 x10⁻⁴ – 4.95x10⁻³ | 1/2 | 3 | 1757 | AAADCCAGAA GCAGTGTTG | CCTGGCTCAGCAC ATGAATA | TD 70-50 | 11 | [29] |

FIGURE 5A (con't)

| OBD ID | Repeat Structure (as defined in Methods and Materials) | Bayesian median mutation rate | Bayesian 95% credible interval | Gains/ Losses | Total Mutations | Total Meioses | Primer 1 Sequence 5'→3' | Primer 2 Sequence 5'→3' | Ta in °C | Multi-plex | Ref |
|---|---|---|---|---|---|---|---|---|---|---|---|
| DYS567 | (ATAA)7-13 | 4.08 x10⁻⁴ | 1.46 x10⁻⁵ – 2.14x10⁻³ | 0/0 | 0 | 1713 | GGAAGCTGACG AAGGAGGAG | TTATGAACGGGAT CAAGTGC | TD 70-50 | 10 | [29] |
| DYS568 | (AAAT)9-13 | 1.66 x10⁻³ | 1.56 x10⁻⁴ – 3.66x10⁻³ | 0/1 | 1 | 1547 | GTGGAGACAA AACCCAGTT | TTGAAAGGGATG GGAGTCA | TD 70-50 | 3 | [29] |
| DYS569 | (ATTT)8.2-13 | 1.58 x10⁻³ | 3.66 x10⁻⁴ – 4.24x10⁻³ | 0/2 | 2 | 1696 | TCCATGGGATAT CATGACCA | GGCAGCCTGTAGG ACAGAGA | TD 70-50 | 12 | [29] |
| DYS571 | (TTTC)4N7(TTTA)8-12 | 4.13 x10⁻⁴ | 1.51 x10⁻⁵ – 2.20x10⁻³ | 0/0 | 0 | 1632 | AGCCTTGAGGG ACTGGTTTA | AGCTGAATCATC CCATTGC | TD 70-50 | 47 | [29] |
| DYS572 | (AAAT)8-13 | 2.57 x10⁻⁴ | 6.17 x10⁻⁴ – 4.96x10⁻³ | 0/3 | 3 | 1770 | CTAAGGACAGCC TCCCATACA | CTCATTCCCTATG GTTTGCAC | TD 70-50 | 9 | [29] |
| DYS573 | (TTTA)8-13 | 4.10 x10⁻⁴ | 1.51 x10⁻⁵ – 2.17x10⁻³ | 0/0 | 0 | 1696 | GGGGCAGAAAA AGTTTGGTG | AAAAATGGGGAG GTGGAAT | TD 70-50 | 14 | [29] |
| DYS574 | (TTAT)8-12 | 9.77 x10⁻⁴ | 1.42 x10⁻⁴ – 3.25x10⁻³ | 0/1 | 1 | 1721 | GGTGCGGCTTCC ATATTTTT | AATGTAGACGAGG GGTTGATG | TD 63-50 | 43 | [29] |
| DYS575 | (AAAT)8-11 | 3.91 x10⁻⁴ | 1.47 x10⁻⁵ – 2.09x10⁻³ | 0/0 | 0 | 1764 | GGTGGTGGACA TCCGTAATC | AGTAATGGGATGC TGGGTCA | TD 70-50 | 11 | [29] |
| DYS577 | (ATTC)6-10 | 4.11 x10⁻⁴ | 1.51 x10⁻⁵ – 2.15x10⁻³ | 0/0 | 0 | 1691 | TCAATGCATGTT TTTCTAGGTG | GGAGGATGGTTTG AACCTGA | TD 60-50 | 40 | [29] |
| DYS578 | (AAAT)7-10 | 9.95 x10⁻⁴ | 1.43 x10⁻⁴ – 3.20x10⁻³ | 1/0 | 1 | 1856 | GAGGCGGAACT TTCAGTGAG | GCTTCAACAACCC TGGACAT | TD 70-50 | 4 | [29] |
| DYS579 | (TATT)7-10 | 3.94 x10⁻⁴ | 1.40 x10⁻⁵ – 2.10x10⁻³ | 0/0 | 0 | 1755 | GCCAGTGGGTAG ACCCAGACT | AGGCAGAGGTTGC AGTGAGT | TD 70-50 | 2 | [29] |
| DYS580 | (AATA)8-10 | 4.05 x10⁻⁴ | 1.47 x10⁻⁵ – 2.13x10⁻³ | 0/0 | 0 | 1725 | GGAGGGAAACCG AGATCAGG | GGACAAAACACT GCAATTTCC | TD 70-50 | 4 | [29] |
| DYS581 | (TAGG)7-9 | 3.84 x10⁻⁴ | 1.43 x10⁻⁵ – 2.04x10⁻³ | 0/0 | 0 | 1807 | GTAGGGTCTTGA ACAGCATACG | GGAAGCCAAGCTGC TGTTAT | TD 70-50 | 36 | [29] |
| DYS583 | (AAAC)7-9 | 3.99 x10⁻⁴ | 1.44 x10⁻⁵ – 2.12x10⁻³ | 0/0 | 0 | 1730 | GCAGGAAAAT GCTTGAACC | CCTCATCCAATAG CTCTTCCT | TD 70-50 | 2 | [29] |
| DYS584 | (CAAT)7-8 | 3.90 x10⁻⁴ | 1.43 x10⁻⁵ – 2.12x10⁻³ | 0/0 | 0 | 1777 | TGCAGAATGTAT GGTCTTTTTGA | CTGCCAGTCTATT GCCCTTC | TD 60-50 | 45 | [29] |

FIGURE 5A (con't)

| GDB ID | Repeat Structure (as defined in Methods and Materials) | Bayesian median mutation rate | Bayesian 95% credible interval | Gains/ Losses | Total Mutations | Total Meioses | Primer 1 Sequence 5'→3' | Primer 2 Sequence 5'→3' | Ta in °C | Multi- plex | Ref |
|---|---|---|---|---|---|---|---|---|---|---|---|
| | | | $2.10 \times 10^{-3}$ | | | | | | | | |
| DYS585 | (TTATG)8-12 | $2.12 \times 10^{-3}$ | $6.33 \times 10^{-4} - 5.05 \times 10^{-3}$ | 2/1 | 3 | 1734 | TGGAAGTATTCC ACTCACTGCT | CTCAAGTGGGAA GTCAAGG | TD 60-50 | 42 | [29] |
| DYS587 | (CAATA)18(CAGTA)1(CAATA)13 | $2.62 \times 10^{-3}$ | $9.16 \times 10^{-4} - 5.75 \times 10^{-3}$ | 2/2 | 4 | 1732 | CCTAAAGCGAA GAGACCATGA | TGAAGGCAAAG AGTGAAAGA | TD 60-50 | 13 | [29] |
| DYS588 | (GCATT)9-16 | $3.92 \times 10^{-4}$ | $1.47 \times 10^{-5} - 2.10 \times 10^{-3}$ | 0/0 | 0 | 1747 | GAATGCAGAAC CCTCAAGGA | AGCCTGGGTGACA GAACAC | TD 60-50 | 42 | [29] |
| DYS590 | (TTTG)8-9 | $3.91 \times 10^{-4}$ | $1.45 \times 10^{-5} - 2.09 \times 10^{-3}$ | 0/0 | 0 | 1730 | GCGAACATAGT CGGGCTGTA | GGGTGAACAAGC AAGAATCC | TD 60-50 | 5 | [29] |
| DYS593 | (AAAAC)4(AAAAY)7-10 | $1.51 \times 10^{-3}$ | $3.47 \times 10^{-4} - 4.05 \times 10^{-3}$ | 1/1 | 2 | 1775 | CTTGAACCCAG GAAGCAGAGA | TTATGCCCAAGTG ACACTG | TD 60-50 | 29 | [29] |
| DYS594 | (AAATA)8-13 | $1.03 \times 10^{-3}$ | $1.46 \times 10^{-4} - 3.41 \times 10^{-3}$ | 1/0 | 1 | 1635 | GATGTGCCTAAT GCCAGAGA | CCCTGGTGTTAAT CGTGTCC | TD 70-50 | 5 | [29] |
| DYS595 | (ATTTA)6-9 | $3.96 \times 10^{-4}$ | $1.49 \times 10^{-5} - 2.16 \times 10^{-3}$ | 0/0 | 0 | 1750 | TGTTTCGGTTC CTGTGTC | AGGGAACAACA CACACTGG | TD 70-50 | 28 | [29] |
| DYS596 | (GGA)5(GTA)1(GGA)13 (GAA)3 [GGA]14GAA)18-19 | $4.24 \times 10^{-4}$ | $1.52 \times 10^{-5} - 2.28 \times 10^{-3}$ | 0/0 | 0 | 1630 | ATAACGTGCCC TTACTGC | TTTTGACAAGCCC AAAGTTCT | TD 60-50 | 44 | [29] |
| DYS611 | (TTC)5N9(TTC)4(GTC)1(TTC)3N9(TTC)5 (CTC)1(TTC)3N15(TTC)4(CT)1(TTC)3 (CTC)1(TTC)3 N2nTTC)3T(TTC)4N7 (CTC)1N9(TTC)4 (TCC)1TTC17-21N23 [TTC]2N4 [TTC)1(CTC)10[CTC)1(TTC)13 | $8.89 \times 10^{-3}$ | $4.66 \times 10^{-3} - 1.47 \times 10^{-2}$ | 3/9 | 12 | 1428 | TACAGGTGTGCA CCATGAG | CTTGGCAACATAG CAGATCC | TD 70-50 | 35 | [29] |
| DYS613 | (ATG)4(ATA)1(ATG)8-9 | $4.35 \times 10^{-3}$ | $1.60 \times 10^{-3} - 2.32 \times 10^{-2}$ | 0/0 | 0 | 1586 | ATGAAGGCAA ATTCTTTATCAA | AAAGTTAATGACG CGTTGTC | TD 60-50 | 23 | [29] |
| DYS614 | (CTT)4(CCT)1(CTT)3N15(CCT)3(CTT)4(CC T)1 (CTT)3N13(CCT)3(CT)5N20 [CCT)1(CT)6]3 (CT)1(CTT)12-22N8 (CTT)6(CTC)1(CTT)3 [CTC)1(TTC)1(CTT)5 | $4.32 \times 10^{-3}$ | $1.84 \times 10^{-3} - 8.14 \times 10^{-3}$ | 2/5 | 7 | 1776 | GTGGCGATGTTC TGAGTGTT | GCCACCAAAAGGT TTCAGA | TD 70-50 | 33 | [29] |
| DYS615 | (TT)17-8 | $3.91 \times 10^{-4}$ | $1.43 \times 10^{-5} - 2.09 \times 10^{-3}$ | 0/0 | 0 | 1766 | GGTCGAAGAAG GTGTCACAGA | TGATTCTGCTAAT TCCCATGC | TD 70-50 | 25 | [29] |
| DYS616 | (TAT)8-16(CAT)1(TAT)3 | $1.72 \times 10^{-3}$ | $4.05 \times 10^{-4} - 4.64 \times 10^{-3}$ | 1/1 | 2 | 1564 | GGCAAACACAT AGCAATTTACA | TGTTTCTGCCCAG CAGTAT | TD 70-50 | 35 | [29] |

FIGURE 5A (cont'd)

| GBD ID | Repeat Structure (as defined in Methods and Materials) | Bayesian median mutation rate | Bayesian 95% credible interval | Gains/Losses | Total Mutations | Total Meioses | Primer 1 Sequence 5'→3' | Primer 2 Sequence 5'→3' | Ta in °C | Multi-plex | Ref |
|---|---|---|---|---|---|---|---|---|---|---|---|
| DYS617 | (TTA)11-15 | $4.13 \times 10^{-4}$ | $1.53 \times 10^{-5} - 2.21 \times 10^{-3}$ | 0/0 | 0 | 1634 | AGCATGATGCCT TCAGCTTT | GGATGGGAGTG ATAGCAT | TD 70-50 | 5 | [29] |
| DYS618 | (TAT)8-14 | $3.95 \times 10^{-4}$ | $1.46 \times 10^{-5} - 2.02 \times 10^{-3}$ | 0/0 | 0 | 1766 | CCCATACCCTTG GTGTGTC | GAGAGCTATGG AGGATAG | TD 70-50 | 13 | [29] |
| DYS619 | (AAT)6-10 | $4.69 \times 10^{-4}$ | $1.70 \times 10^{-5} - 2.50 \times 10^{-3}$ | 0/0 | 0 | 1479 | GGCGACAGAGC GAGACTCTA | GGCATGTGAGTTG AGGAACA | TD 70-50 | 16 | [29] |
| DYS620 | (ATA)6-9 | $4.11 \times 10^{-4}$ | $1.47 \times 10^{-5} - 2.22 \times 10^{-3}$ | 0/0 | 0 | 1673 | TGAGTAGTTAAT GGGTGCAG | TGAGTTGCTCCT CTAGCTTC | TD 60-50 | 40 | [29] |
| DYS621 | (TTA)7-9 | $4.44 \times 10^{-4}$ | $1.70 \times 10^{-5} - 2.35 \times 10^{-3}$ | 0/0 | 0 | 1543 | GCCCAAATTAA AAGGCACAA | TGACGAGTTAGTG GGTGCAG | TD 70-50 | 35 | [29] |
| DYS622 | (GAAA)6(AGAAG)1(GAAA)8-16 | $3.40 \times 10^{-3}$ | $1.32 \times 10^{-3} - 7.01 \times 10^{-3}$ | 2/3 | 5 | 1663 | TCGAGCTCGGT GATAAGAG | GGCTGAAGTGGGT TGTGTTA | TD 60-50 | 44 | [29] |
| DYS624 | (GGAT)6-10(AGAT)1N35(GGAT)3 | $4.88 \times 10^{-4}$ | $1.55 \times 10^{-5} - 2.16 \times 10^{-3}$ | 0/0 | 0 | 1699 | GCATCTCAAATC CTTGTCGA | TCGACCTGCTTT CTCTTCA | TD 60-50 | 43 | [29] |
| DYS625 | (CTT)4(TGT)4(CTTT)3(CTTT)1(CTTT)4 (TT)1 (CTT)2N47(CTTT)3-6(CT)1 (CTT)4(CCTT)1 CTT(T)2N46(CTTT)3 | $9.58 \times 10^{-4}$ | $1.40 \times 10^{-4} - 3.18 \times 10^{-3}$ | 0/1 | 1 | 1746 | TCATCACACATG GCCTAATTG | GGCAAGTCACATG CATTACAA | TD 60-50 | 22 | [29] |
| DYS629 | (TATC)8-12 | $9.91 \times 10^{-4}$ | $1.41 \times 10^{-4} - 3.31 \times 10^{-3}$ | 1/0 | 1 | 1639 | GGGATTATTACA ATTCAAGGTC | TATGGGTAAATCG CAAAAGT | TD 60-50 | 19 | [29] |
| DYS630 | (AAAG)14(ACAAG)5N18(AAAG)12-23 | $4.86 \times 10^{-3}$ | $2.31 \times 10^{-3} - 8.85 \times 10^{-3}$ | 5/3 | 8 | 1784 | GCCTTTGGACAG AGCAAGAC | AGCATGGAAAG CTGTGAGT | TD 70-50 | 25 | [29] |
| DYS631 | (AATA)4(GATA)1(AATA)7-11 | $9.77 \times 10^{-4}$ | $1.40 \times 10^{-4} - 3.25 \times 10^{-3}$ | 0/1 | 1 | 1721 | CACTCCAGCCTC GGAGATAG | GCGCTCTCGGAC ATTATCA | TD 60-50 | 45 | [29] |
| DYS632 | (CATT)8-10 | $3.97 \times 10^{-4}$ | $1.47 \times 10^{-5} - 2.13 \times 10^{-3}$ | 0/0 | 0 | 1745 | GCGGTTGCAA AATAAACTG | TCTGGGAACAGA AGGAGAC | TD 70-50 | 24 | [29] |
| DYS633 | (AAAT)3N18(AAAT)7-9 | $3.81 \times 10^{-4}$ | $1.38 \times 10^{-5} - 2.02 \times 10^{-3}$ | 0/0 | 0 | 1614 | GGGAACAAGAG CAAAACTCC | CCACCAGGAAGT GTCTTTC | TD 60-50 | 46 | [29] |
| DYS634 | (GGAA)6N10(AAGG)7-16N12(AGGG)3 | $4.20 \times 10^{-4}$ | $1.51 \times 10^{-5} - 2.25 \times 10^{-3}$ | 0/0 | 0 | 1646 | TCAGAAGCCATG CTAGAAGCCTA | TTGCTCCTTACAG AAGAGGTGA | TD 60-50 | 19 | [29] |

FIGURE 5A (con't)

| GDB ID | Repeat Structure (as defined in Methods and Materials) | Bayesian median mutation rate | Bayesian 95% credible interval | Gains/ Losses | Total Mutations | Total Meioses | Primer 1 Sequence 5'-3' | Primer 2 Sequence 5'-3' | Ta in °C | Multi-plex | Ref |
|---|---|---|---|---|---|---|---|---|---|---|---|
| DYS635 | (TCTA)4(TGTA)2(TCTA)2(TGTA)2 (TCTA)2 (TATG)3-2(TCTA)4-17 | 3.85×10⁻³ | 1.63×10⁻³ – 7.55×10⁻³ | 1/5 | 6 | 1732 | Yfiler | Yfiler | Yfiler | Yfiler | [29] |
| DYS637 | (AAAT)14(ACAT)8-14 | 1.04×10⁻³ | 1.53×10⁻⁴ – 3.42×10⁻³ | 0/1 | 1 | 1623 | AAGCCAGTCAA CCAAACACA | TGCTGGCGTTGAA GGTAAAA | TD 60-50 | 41 | [29] |
| DYS638 | (TTTA)8-13 | 1.04×10⁻³ | 1.47×10⁻⁴ – 3.45×10⁻³ | 1/0 | 1 | 1617 | ACAATTTCCCTT GGGGCTAC | CATGGTGGTAGGC ACGTGTA | TD 70-50 | 6 | [29] |
| DYS640 | (AAAT)9-13 | 3.98×10⁻⁴ | 1.41×10⁻⁵ – 2.16×10⁻³ | 1/0 | 1 | 1716 | TCGGAAAAACC ATGAGATCC | TAGGGTCAAGCCC GTTCATA | TD 70-50 | 15 | [29] |
| DYS641 | (TAAA)8-12 | 3.90×10⁻⁴ | 1.41×10⁻⁵ – 2.05×10⁻³ | 0/0 | 0 | 1788 | CTTGAGCCCAG GAAGCATAG | GCAACGATGCAA TTTTGTC | TD 70-50 | 6 | [29] |
| DYS642 | (TAGA)8-10 | 3.91×10⁻⁴ | 1.45×10⁻⁵ – 2.07×10⁻³ | 0/0 | 0 | 1785 | CATTGTGCACGT GTACCCTAA | AAAGGTTGTGCT GCATGAT | TD 70-50 | 33 | [29] |
| DYS643 | (CTTTT)8-15 | 1.50×10⁻³ | 3.49×10⁻⁴ – 4.05×10⁻³ | 2/0 | 2 | 1773 | AAGCCATGCCT GGTTAAACT | TGTAACCAAACAC CACCCATT | TD 70-50 | 14 | [29] |
| DYS644 | (TTTTA)10-11(TTTA)0-1(TTTTA)0-13 | 3.22×10⁻³ | 1.25×10⁻³ – 6.62×10⁻³ | 3/2 | 5 | 1761 | TGACTTCGGGGT AGTCCAG | CCTGGGCAAAAG AGTGAGAC | TD 70-50 | 6 | [29] |
| DYS645 | (TGTTT)7-9 | 4.07×10⁻⁴ | 1.49×10⁻⁵ – 2.14×10⁻³ | 0/0 | 0 | 1696 | GGTTAGGGGTG GCAATCATA | ACTGCCAGACTCA CACATGG | TD 60-50 | 40 | [29] |
| Y-GATA-A10 | (ATCT)11-16 | 3.32×10⁻³ | 1.25×10⁻³ – 6.80×10⁻³ | 3/2 | 5 | 1713 | CCTGCCATCTCT ATTTATCTTGCA TATA | ATAAATGAAGATA GTGGGTCGATT | TD 60-50 | 41 | [29] |
| Y-GATA-H4 | (TAGA)3N12(TAGG)3(TAGA)8-15N22(TAGA)4 | 3.22×10⁻³ | 1.28×10⁻³ – 6.62×10⁻³ | 1/4 | 5 | 1755 | Yfiler | Yfiler | Yfiler | Yfiler | [29] |

Notes: The repeat nomenclature used is in accordance with rules defined by Kayser et al. (2004). Separation of repeat blocks by "N" represents the break point between the separate loci present within complex markers (as described in Methods and Materials). Repeat arrays observed to be variable through sequence analysis are highlighted in bold.
The allele ranges given are those seen with the 1966 father-son pairs of European origin.
The "Total number of Meioses" reported is the number of meioses for the marker, and is not the number of allele transmissions for multicopy markers.
The mutations reported for the Yfiler loci have been previously reported in Reference 28.

FIGURE 5B

| TD60-50 | | | TD65-50 | | | TD65-55 | | | TD70-50 | | |
|---|---|---|---|---|---|---|---|---|---|---|---|
| 95C | 10 min | | 95C | 15 min | | 95C | 10 min | | 95C | 15 min | |
| 94C | 30s | | 94C | 30s | | 94C | 30s | | 94C | 30s | |
| 60-1C | 30s | | 65-1C | 45s | | 65-1C | 30s | | 70-1C | 45s | |
| 72C | 45s | X10 | 72C | 1 min | X10 | 72C | 45s | X10 | 72C | 1 min | X10 |
| 94C | 30s | | 94C | 30s | | 94C | 30s | | 94C | 30s | |
| 50C | 30s | | 50C | 30s | | 55C | 30s | | 50C | 30s | |
| 72C | 45s | X25 | 72C | 45s | X20 | 72C | 45s | X15 | 72C | 45s | X20 |
| 60C | 45min | | 60C | 45min | | 60C | 45min | | 60C | 45min | |
| 15C | forever | | 15C | forever | | 15C | forever | | 15C | forever | X15 |

FIGURE 5C

| | RM 1 (DYF387S1, DYF399S1, DYS570, DYS576) | RM 2 (DYS518, DYS526a/b, DYS626, DYS627) | RM 3 (DYF403S1a/b, DYF404S1, DYS449, DYS547, DYS612) |
|---|---|---|---|
| PCR Buffer | 1x | 1x | 1x |
| MgCl2 | 2.27mM | 1.5mM | 2.0mM |
| dNTPs | 220µM | 250µM | 250µM |
| DYF387S1 Primer | 0.09µM | | |
| DYF399S1 Primer | 0.36µM | | |
| DYS570 Primer | 0.09µM | | |
| DYS576 Primer | 0.09µM | | |
| DYS518 Primer | | 0.5µM | |
| DYS526a/b Primer | | 0.35µM | |
| DYS626 Primer | | 0.2µM | |
| DYS627 Primer | | 0.15µM | |
| DYF403S1a/b Primer | | | 0.6µM |
| DYF404S1 Primer | | | 0.1µM |
| DYS449 Primer | | | 0.1µM |
| DYS547 Primer | | | 0.6µM |
| DYS612 Primer | | | 0.2mM |
| Taq | 0.25U | 0.35U | 0.5U |
| DNA | 2ng | 2ng | 2ng |
| PCR Protocol | TD70-50 | TD65-55 | TD65-55 |

FIGURE 6

| Locus | Father Allele | Son Allele | Father's Age | Father Reference # |
|---|---|---|---|---|
| DYF386S1 | {GGAT}14(AGAT)1(GGAT)3N8(GGAC)3 | {GGAT}14(AGAT)1(GGAT)3N8(GGAC)3 | 59 | 1953 |
| DYF386S1 | {AAT}12 | {AAT}13 | 27 | 20 |
| DYF386S1 | {AAT}14 | {AAT}13 | 32 | 34 |
| DYF386S1 | {AAT}13 | {AAT}12 | 38 | 94 |
| DYF386S1 | {AAT}15 | {AAT}13 | 20 | 208 |
| DYF386S1 | {AAT}14 | {AAT}13 | 25 | 317 |
| DYF386S1 | {AAT}13 | {AAT}12 | 19 | 641 |
| DYF386S1 | {AAT}13 | {AAT}13 | 37 | 1195 |
| DYF386S1 | {AAT}14 | {AAT}15 | 40 | 1553 |
| DYF386S1 | {AAT}4 | {AAT}3 | 42 | 1644 |
| DYF386S1 | {AAT}4 | {AAT}3 | 52 | 1864 |
| DYF387S1 | 21 | 24 | 21 | 46 |
| DYF387S1 | 23 | 22 | 46 | 74 |
| DYF387S1 | 33 | 24 | 36 | 180 |
| DYF387S1 | 20 | 21 | 29 | 185 |
| DYF387S1 | 24 | 23 | 24 | 259 |
| DYF387S1 | 22 | 21 | 28 | 677 |
| DYF387S1 | 24 | 23 | 40 | 733 |
| DYF387S1 | 25 | 24 | 22 | 817 |
| DYF387S1 | 25 | 26 | 36 | 830 |
| DYF387S1 | 25 | 25 | 18 | 852 |
| DYF387S1 | 23 | 24 | 28 | 860 |
| DYF387S1 | 24 | 23 | 19 | 916 |
| DYF387S1 | 21 | 22 | 33 | 955 |
| DYF387S1 | 22 | 23 | 43 | 1159 |
| DYF387S1 | 23 | 24 | Unknown | 1202 |
| DYF387S1 | 24 | 23 | 30 | 1274 |
| DYF387S1 | 23 | 22 | 37 | 1319 |
| DYF387S1 | 23 | 21 | Unknown | 1326 |
| DYF387S1 | 24 | 25 | 31 | 1390 |
| DYF387S1 | 23 | 24 | 39 | 1451 |
| DYF387S1 | 22 | 21 | 24 | 1469 |
| DYF387S1 | 22 | 23 | 38 | 1494 |
| DYF387S1 | 21 | 22 | 39 | 1552 |
| DYF387S1 | 21 | 22 | 20 | 1592 |
| DYF387S1 | 23 | 22 | 42 | 1644 |
| DYF387S1 | 23 | 22 | 23 | 1710 |
| DYF387S1 | 23 | 22 | 19 | 1750 |
| DYF387S1 | 23 | 25 | 54 | 1911 |
| DYF388S1 | (CTTC)6(CTTT)15N18(CTTC)3(TTTC)1 (CTTC)3N6(CTTC)2N32(CTTC)3 | (CTTC)6(CTTT)15N18(CTTC)3(TTTC)1 (CTTC)3N6(CTTC)2N32(CTTC)3 | 57 | 36 |

FIGURE 6 [con't]

| Locus | Father Allele | Son Allele | Father's Age | Father Reference # |
|---|---|---|---|---|
| DYF388S1 | (CTTC)6(CTTT)14N18(CTTC)3(TTTC)1 (CTTC)8(CTTC)3N32(CTTC)3 | (CTTC)6(CTTT)14N18(CTTC)3(TTTC)1 (CTTC)8(CTTC)3N32(CTTC)3 | 34 | 372 |
| DYF388S1 | (CTTC)6(CTTT)12N18(CTTC)3(TTTC)1 (CTTC)8(CTTC)3N32(CTTC)3 | (CTTC)6(CTTT)12N18(CTTC)3(TTTC)1 (CTTC)8(CTTC)3N32(CTTC)3 | 28 | 674 |
| DYF388S1 | (CTTC)6(CTTT)12N18(CTTC)3(TTTC)1 (CTTC)8(CTTC)3N32(CTTC)3 | (CTTC)6(CTTT)13N18(CTTC)3(TTTC)1 (CTTC)8(CTTC)3N32(CTTC)3 | 21 | 769 |
| DYF388S1 | (CTTC)6(CTTT)11N18(CTTC)3(TTTC)1 (CTTC)8(CTTC)3N32(CTTC)3 | (CTTC)6(CTTT)11N18(CTTC)3(TTTC)1 (CTTC)8(CTTC)3N32(CTTC)3 | 49 | 945 |
| DYF388S1 | (CTTC)6(CTTT)12N18(CTTC)3(TTTC)1 (CTTC)8(CTTC)3N32(CTTC)3 | (CTTC)6(CTTT)11N18(CTTC)3(TTTC)1 (CTTC)8(CTTC)3N32(CTTC)3 | 28 | 1035 |
| DYF388S1 | (CTTC)6(CTTT)12N18(CTTC)3(TTTC)1 (CTTC)8(CTTC)3N32(CTTC)3 | (CTTC)6(CTTT)13N18(CTTC)3(TTTC)1 (CTTC)8(CTTC)3N32(CTTC)3 | 30 | 1177 |
| DYF388S1 | (CTTC)6(CTTT)12N18(CTTC)3(TTTC)1 (CTTC)8(CTTC)3N32(CTTC)3 | (CTTC)6(CTTT)12N18(CTTC)3(TTTC)1 (CTTC)8(CTTC)3N32(CTTC)3 | 36 | 1272 |
| DYF388S1 | (CTTC)6(CTTT)13N18(CTTC)3(TTTC)1 (CTTC)8(CTTC)3N32(CTTC)3 | (CTTC)6(CTTT)12N18(CTTC)3(TTTC)1 (CTTC)8(CTTC)3N32(CTTC)3 | Unknown | 1352 |
| DYF388S1 | (CTTC)6(CTTT)13N18(CTTC)3(TTTC)1 (CTTC)8(CTTC)3N32(CTTC)3 | (CTTC)6(CTTT)12N18(CTTC)3(TTTC)1 (CTTC)8(CTTC)3N32(CTTC)3 | 31 | 1518 |
| DYF388S1 | (CTTC)6(CTTT)14N18(CTTC)3(TTTC)1 (CTTC)8(CTTC)3N32(CTTC)3 | (CTTC)6(CTTT)12N18(CTTC)3(TTTC)1 (CTTC)8(CTTC)3N32(CTTC)3 | 28 | 1734 |
| DYF399S1 | (TTTA)11 | (TTTA)10 | 21 | 1667 |
| DYF399S1 | (AAG)4(AA)1(AAG)26(CAG)1 | (AAG)4(AA)1(AAG)25(CAG)1 | 32 | 19 |
| DYF399S1 | (AAG)4(AA)1(AAG)26(CAG)1 | (AAG)4(AA)1(AAG)26(CAG)1 | 32 | 84 |
| DYF399S1 | (AAG)4(AA)1(AAG)19(CAG)1 | (AAG)4(AA)1(AAG)26(CAG)1 | 34 | 185 |
| DYF399S1 | (AAG)4(AA)1(AAG)26(CAG)1 | (AAG)4(AA)1(AAG)25(CAG)1 | 32 | 213 |
| DYF399S1 | (AAG)4(AA)1(AAG)25(CAG)1 | (AAG)4(AA)1(AAG)24(CAG)1 | 26 | 303 |
| DYF399S1 | (AAG)4(AA)1(AAG)22(CAG)1 | (AAG)4(AA)1(AAG)23(CAG)1 | 31 | 927 |
| DYF399S1 | (AAG)4(AA)1(AAG)26(CAG)2 | (AAG)4(AA)1(AAG)27(CAG)2 | 23 | 941 |
| DYF399S1 | (AAG)4(AA)1(AAG)22(CAG)1 | (AAG)4(AA)1(AAG)23(CAG)1 | 64 | 951 |
| DYF399S1 | (AAG)4(AA)1(AAG)27(CAG)1 | (AAG)4(AA)1(AAG)26(CAG)1 | 21 | 1207 |
| DYF399S1 | (AAG)4(AA)1(AAG)22(CAG)1 | (AAG)4(AA)1(AAG)24(CAG)1 | 17 | 1406 |
| DYF399S1 | (AAG)4(AA)1(AAG)28(CAG)1 | (AAG)4(AA)1(AAG)29(CAG)1 | 19 | 1530 |
| DYF399S1 | (AAG)4(AA)1(AAG)27(CAG)1 | (AAG)4(AA)1(AAG)26(CAG)1 | 26 | 1551 |
| DYF399S1 | (AAG)4(AA)1(AAG)23(CAG)1 | (AAG)4(AA)1(AAG)24(CAG)1 | 36 | 1672 |
| DYF399S1 | (AAG)4(AA)1(AAG)25(CAG)1 | (AAG)4(AA)1(AAG)24(CAG)1 | 55 | 1926 |
| DYF399S1 | (GAAA)3N8(GAAA)19 | (GAAA)3N8(GAAA)20 | 22 | 14 |
| DYF399S1 | (GAAA)3N8(GAAA)15 | (GAAA)3N8(GAAA)17 | 46 | 21 |
| DYF399S1 | (GAAA)3N8(GAAA)19 | (GAAA)3N8(GAAA)20 | 36 | 22 |
| DYF399S1 | (GAAA)3N7(GAAA)18 | (GAAA)3N8(GAAA)19 | 30 | 25 |
| DYF399S1 | (GAAA)3N7(GAAA)1 | (GAAA)3N8(GAAA)20 | 32 | 32 |

FIGURE 6 [con't]

| Locus | Father Allele | Son Allele | Father's Age | Father Reference # |
|---|---|---|---|---|
| DYF399S1 | (GAAA)3N8(GAAA)20 | (GAAA)3N8(GAAA)19 | 16 | 55 |
| DYF399S1 | (GAAA)3N7(GAAA)18 | (GAAA)3N8(GAAA)19 | 32 | 59 |
| DYF399S1 | (GAAA)3N9(GAAA)20 | (GAAA)3N8(GAAA)19 | 30 | 62 |
| DYF399S1 | (GAAA)3N8(GAAA)19 | (GAAA)3N7(GAAA)16 | 46 | 72 |
| DYF399S1 | (GAAA)3N7(GAAA)19 | (GAAA)3N8(GAAA)19 | 46 | 72 |
| DYF399S1 | (GAAA)3N8(GAAA)19 | (GAAA)3N6(GAAA)20 | 25 | 79 |
| DYF399S1 | (GAAA)3N8(GAAA)19 | (GAAA)3N6(GAAA)20 | 25 | 80 |
| DYF399S1 | (GAAA)3N6(GAAA)20 | (GAAA)3N6(GAAA)19 | 28 | 91 |
| DYF399S1 | (GAAA)3N7(GAAA)21 | (GAAA)3N8(GAAA)20 | 32 | 95 |
| DYF399S1 | (GAAA)3N8(GAAA)17 | (GAAA)3N8(GAAA)16 | 30 | 99 |
| DYF399S1 | (GAAA)3N8(GAAA)20 | (GAAA)3N8(GAAA)19 | 27 | 119 |
| DYF399S1 | (GAAA)3N8(GAAA)19 | (GAAA)3N7(GAAA)18 | 46 | 122 |
| DYF399S1 | (GAAA)3N7(GAAA)18 | (GAAA)3N8(GAAA)18 | 33 | 126 |
| DYF399S1 | (GAAA)3N7(GAAA)17 | (GAAA)3N8(GAAA)16 | 36 | 136 |
| DYF399S1 | (GAAA)3N8(GAAA)19 | (GAAA)3N8(GAAA)20 | 28 | 153 |
| DYF399S1 | (GAAA)3N7(GAAA)19 | (GAAA)3N8(GAAA)17 | 33 | 189 |
| DYF399S1 | (GAAA)3N7(GAAA)17 | (GAAA)3N8(GAAA)18 | 39 | 200 |
| DYF399S1 | (GAAA)3N8(GAAA)18 | (GAAA)3N8(GAAA)15 | 22 | 203 |
| DYF399S1 | (GAAA)3N8(GAAA)19 | (GAAA)3N7(GAAA)19 | 22 | 229 |
| DYF399S1 | (GAAA)3N7(GAAA)16 | (GAAA)3N8(GAAA)15 | 50 | 270 |
| DYF399S1 | (GAAA)3N8(GAAA)19 | (GAAA)3N8(GAAA)20 | 28 | 297 |
| DYF399S1 | (GAAA)3N8(GAAA)21 | (GAAA)3N7(GAAA)17 | 32 | 290 |
| DYF399S1 | (GAAA)3N9(GAAA)15 | (GAAA)3N8(GAAA)20 | 21 | 289 |
| DYF399S1 | (GAAA)3N8(GAAA)18 | (GAAA)3N7(GAAA)17 | 27 | 302 |
| DYF399S1 | (GAAA)3N7(GAAA)21 | (GAAA)3N8(GAAA)16 | 38 | 336 |
| DYF399S1 | (GAAA)3N8(GAAA)15 | (GAAA)3N8(GAAA)17 | 50 | 356 |
| DYF399S1 | (GAAA)3N7(GAAA)17 | (GAAA)3N7(GAAA)18 | 28 | 367 |
| DYF399S1 | (GAAA)3N8(GAAA)16 | (GAAA)3N8(GAAA)16 | 34 | 372 |
| DYF399S1 | (GAAA)3N7(GAAA)17 | (GAAA)3N8(GAAA)19 | 28 | 373 |
| DYF399S1 | (GAAA)3N7(GAAA)18 | (GAAA)3N7(GAAA)17 | 35 | 389 |
| DYF399S1 | (GAAA)3N7(GAAA)19 | (GAAA)3N8(GAAA)17 | 32 | 401 |
| DYF399S1 | (GAAA)3N7(GAAA)21 | (GAAA)3N8(GAAA)18 | 53 | 453 |
| DYF399S1 | (GAAA)3N8(GAAA)17 | (GAAA)3N7(GAAA)18 | 34 | 459 |
| DYF399S1 | (GAAA)3N8(GAAA)18 | (GAAA)3N8(GAAA)16 | 26 | 460 |
| DYF399S1 | (GAAA)3N7(GAAA)19 | (GAAA)3N8(GAAA)19 | 28 | 484 |
| DYF399S1 | (GAAA)3N8(GAAA)21 | (GAAA)3N7(GAAA)18 | 26 | 483 |
| DYF399S1 | (GAAA)3N7(GAAA)19 | (GAAA)3N8(GAAA)20 | 39 | 492 |
| DYF399S1 | (GAAA)3N8(GAAA)19 | (GAAA)3N6(GAAA)20 | 27 | 494 |
| DYF399S1 | (GAAA)3N8(GAAA)16 | (GAAA)3N8(GAAA)15 | 35 | 500 |
| DYF399S1 | (GAAA)3N8(GAAA)16 | (GAAA)3N8(GAAA)15 | 19 | 546 |

FIGURE 6 [con't]

| Locus | Father Allele | Son Allele | Father's Age | Father Reference # |
|---|---|---|---|---|
| DYF399S1 | (GAAA)3N8(GAAA)19 | (GAAA)3N8(GAAA)20 | 24 | 569 |
| DYF399S1 | (GAAA)3N7(GAAA)21 | (GAAA)3N8(GAAA)22 | 30 | 586 |
| DYF399S1 | (GAAA)3N9(GAAA)20 | (GAAA)3N8(GAAA)19 | 29 | 603 |
| DYF399S1 | (GAAA)3N7(GAAA)18 | (GAAA)3N8(GAAA)17 | 56 | 803 |
| DYF399S1 | (GAAA)3N7(GAAA)19 | (GAAA)3N7(GAAA)18 | 32 | 814 |
| DYF399S1 | (GAAA)3N8(GAAA)17 | (GAAA)3N7(GAAA)16 | 43 | 824 |
| DYF399S1 | (GAAA)3N7(GAAA)20 | (GAAA)3N8(GAAA)19 | 25 | 630 |
| DYF399S1 | (GAAA)3N7(GAAA)21 | (GAAA)3N8(GAAA)20 | 30 | 640 |
| DYF399S1 | (GAAA)3N8(GAAA)19 | (GAAA)3N7(GAAA)18 | 43 | 657 |
| DYF399S1 | (GAAA)3N8(GAAA)22 | (GAAA)3N8(GAAA)21 | 25 | 666 |
| DYF399S1 | (GAAA)3N8(GAAA)19 | (GAAA)3N7(GAAA)20 | 23 | 675 |
| DYF399S1 | (GAAA)3N8(GAAA)19 | (GAAA)3N7(GAAA)18 | 16 | 689 |
| DYF399S1 | (GAAA)3N8(GAAA)17 | (GAAA)3N8(GAAA)19 | 23 | 697 |
| DYF399S1 | (GAAA)3N8(GAAA)17 | (GAAA)3N7(GAAA)18 | 20 | 706 |
| DYF399S1 | (GAAA)3N8(GAAA)15 | (GAAA)3N8(GAAA)20 | 33 | 718 |
| DYF399S1 | (GAAA)3N8(GAAA)15 | (GAAA)3N7(GAAA)14 | 21 | 720 |
| DYF399S1 | (GAAA)3N8(GAAA)20 | (GAAA)3N8(GAAA)19 | 22 | 747 |
| DYF399S1 | (GAAA)3N7(GAAA)20 | (GAAA)3N7(GAAA)15 | 28 | 772 |
| DYF399S1 | (GAAA)3N8(GAAA)19 | (GAAA)3N8(GAAA)20 | 28 | 805 |
| DYF399S1 | (GAAA)3N8(GAAA)22 | (GAAA)3N8(GAAA)22 | 22 | 817 |
| DYF399S1 | (GAAA)3N7(GAAA)21 | (GAAA)3N8(GAAA)21 | 20 | 824 |
| DYF399S1 | (GAAA)3N8(GAAA)20 | (GAAA)3N7(GAAA)19 | 20 | 827 |
| DYF399S1 | (GAAA)3N8(GAAA)19 | (GAAA)3N7(GAAA)18 | 25 | 877 |
| DYF399S1 | (GAAA)3N8(GAAA)16 | (GAAA)3N7(GAAA)17 | 31 | 881 |
| DYF399S1 | (GAAA)3N8(GAAA)15 | (GAAA)3N7(GAAA)14 | 19 | 900 |
| DYF399S1 | (GAAA)3N8(GAAA)16 | (GAAA)3N8(GAAA)17 | 37 | 904 |
| DYF399S1 | (GAAA)3N7(GAAA)20 | (GAAA)3N8(GAAA)19 | 34 | 911 |
| DYF399S1 | (GAAA)3N7(GAAA)20 | (GAAA)3N8(GAAA)20 | 41 | 916 |
| DYF399S1 | (GAAA)3N8(GAAA)21 | (GAAA)3N8(GAAA)17 | 19 | 916 |
| DYF399S1 | (GAAA)3N7(GAAA)20 | (GAAA)3N8(GAAA)19 | 41 | 1008 |
| DYF399S1 | (GAAA)3N8(GAAA)15 | (GAAA)3N8(GAAA)15 | 33 | 1046 |
| DYF399S1 | (GAAA)3N7(GAAA)13 | (GAAA)3N8(GAAA)16 | 24 | 926 |
| DYF399S1 | (GAAA)3N8(GAAA)16 | (GAAA)3N7(GAAA)18 | 22 | 985 |
| DYF399S1 | (GAAA)3N7(GAAA)20 | (GAAA)3N7(GAAA)21 | 36 | 989 |
| DYF399S1 | (GAAA)3N7(GAAA)16 | (GAAA)3N7(GAAA)17 | 35 | 1001 |
| DYF399S1 | (GAAA)3N7(GAAA)21 | (GAAA)3N8(GAAA)20 | 41 | 1006 |
| DYF399S1 | (GAAA)3N8(GAAA)15 | (GAAA)3N8(GAAA)16 | 33 | 1046 |
| DYF399S1 | (GAAA)3N8(GAAA)19 | (GAAA)3N8(GAAA)18 | 31 | 1072 |
| DYF399S1 | (GAAA)3N8(GAAA)20 | (GAAA)3N7(GAAA)19 | 22 | 1068 |
| DYF399S1 | (GAAA)3N7(GAAA)18 | (GAAA)3N8(GAAA)19 | 36 | 1091 |
| DYF399S1 | (GAAA)3N7(GAAA)15 | (GAAA)3N8(GAAA)16 | 23 | 1095 |

FIGURE 6 [con't]

| Locus | Father Allele | Son Allele | Father's Age | Father Reference # |
|---|---|---|---|---|
| DYF399S1 | (GAAA)3N8(GAAA)17 | (GAAA)3N7(GAAA)18 | 25 | 1104 |
| DYF399S1 | (GAAA)3N8(GAAA)20 | (GAAA)3N8(GAAA)19 | 43 | 1136 |
| DYF399S1 | (GAAA)3N7(GAAA)18 | (GAAA)3N8(GAAA)17 | 29 | 1154 |
| DYF399S1 | (GAAA)3N8(GAAA)17 | (GAAA)3N8(GAAA)16 | 26 | 1155 |
| DYF399S1 | (GAAA)3N8(GAAA)16 | (GAAA)3N8(GAAA)17 | 34 | 1158 |
| DYF399S1 | (GAAA)3N7(GAAA)22 | (GAAA)3N7(GAAA)21 | 34 | 1159 |
| DYF399S1 | (GAAA)3N7(GAAA)18 | (GAAA)3N7(GAAA)17 | 43 | 1160 |
| DYF399S1 | (GAAA)3N8(GAAA)13 | (GAAA)3N8(GAAA)14 | 21 | 1163 |
| DYF399S1 | (GAAA)3N8(GAAA)19 | (GAAA)3N7(GAAA)18 | 21 | 1207 |
| DYF399S1 | (GAAA)3N7(GAAA)21 | (GAAA)3N8(GAAA)20 | Unknown | 1263 |
| DYF399S1 | (GAAA)3N7(GAAA)18 | (GAAA)3N8(GAAA)19 | Unknown | 1265 |
| DYF399S1 | (GAAA)3N8(GAAA)20 | (GAAA)3N8(GAAA)19 | Unknown | 1268 |
| DYF399S1 | (GAAA)3N8(GAAA)17 | (GAAA)3N8(GAAA)16 | 39 | 1327 |
| DYF399S1 | (GAAA)3N7(GAAA)21 | (GAAA)3N7(GAAA)20 | 27 | 1397 |
| DYF399S1 | (GAAA)3N8(GAAA)14 | (GAAA)3N8(GAAA)13 | 42 | 1407 |
| DYF399S1 | (GAAA)3N8(GAAA)19 | (GAAA)3N7(GAAA)20 | 42 | 1411 |
| DYF399S1 | (GAAA)3N7(GAAA)22 | (GAAA)3N8(GAAA)21 | 40 | 1443 |
| DYF399S1 | (GAAA)3N8(GAAA)17 | (GAAA)3N8(GAAA)15 | 17 | 1446 |
| DYF399S1 | (GAAA)3N7(GAAA)18 | (GAAA)3N8(GAAA)19 | 24 | 1455 |
| DYF399S1 | (GAAA)3N8(GAAA)15 | (GAAA)3N8(GAAA)16 | 16 | 1458 |
| DYF399S1 | (GAAA)3N7(GAAA)20 | (GAAA)3N7(GAAA)21 | 24 | 1460 |
| DYF399S1 | (GAAA)3N8(GAAA)17 | (GAAA)3N7(GAAA)18 | 24 | 1466 |
| DYF399S1 | (GAAA)3N8(GAAA)16 | (GAAA)3N8(GAAA)15 | 39 | 1471 |
| DYF399S1 | (GAAA)3N8(GAAA)19 | (GAAA)3N7(GAAA)20 | Unknown | 1479 |
| DYF399S1 | (GAAA)3N8(GAAA)19 | (GAAA)3N8(GAAA)18 | 28 | 1554 |
| DYF399S1 | (GAAA)3N8(GAAA)17 | (GAAA)3N7(GAAA)18 | 37 | 1577 |
| DYF399S1 | (GAAA)3N8(GAAA)14 | (GAAA)3N8(GAAA)15 | 40 | 1606 |
| DYF399S1 | (GAAA)3N8(GAAA)19 | (GAAA)3N7(GAAA)18 | 25 | 1612 |
| DYF399S1 | (GAAA)3N8(GAAA)22 | (GAAA)3N7(GAAA)21 | 32 | 1620 |
| DYF399S1 | (GAAA)3N8(GAAA)19 | (GAAA)3N8(GAAA)20 | 17 | 1650 |
| DYF399S1 | (GAAA)3N8(GAAA)15 | (GAAA)3N8(GAAA)14 | Unknown | 1651 |
| DYF399S1 | (GAAA)3N8(GAAA)18 | (GAAA)3N7(GAAA)19 | 24 | 1658 |
| DYF399S1 | (GAAA)3N7(GAAA)18 | (GAAA)3N8(GAAA)19 | 37 | 1663 |
| DYF399S1 | (GAAA)3N7(GAAA)22 | (GAAA)3N7(GAAA)21 | 32 | 1664 |
| DYF399S1 | (GAAA)3N8(GAAA)15 | (GAAA)3N8(GAAA)20 | 17 | 1665 |
| DYF399S1 | (GAAA)3N8(GAAA)15 | (GAAA)3N8(GAAA)14 | 20 | 1670 |
| DYF399S1 | (GAAA)3N8(GAAA)18 | (GAAA)3N8(GAAA)19 | 34 | 1691 |
| DYF399S1 | (GAAA)3N8(GAAA)20 | (GAAA)3N7(GAAA)21 | 28 | 1696 |
| DYF399S1 | (GAAA)3N8(GAAA)19 | (GAAA)3N7(GAAA)18 | 23 | 1722 |
| DYF399S1 | (GAAA)3N8(GAAA)16 | (GAAA)3N8(GAAA)17 | 30 | 1733 |

FIGURE 6 [con't]

| Locus | Father Allele | Son Allele | Father's Age | Father Reference # |
|---|---|---|---|---|
| DYF399S1 | (GAAA)13N8(GAAA)20 | (GAAA)13N7(GAAA)21 | 29 | 1760 |
| DYF399S1 | (GAAA)13N8(GAAA)17 | (GAAA)13N7(GAAA)18 | 29 | 1773 |
| DYF399S1 | (GAAA)13N8(GAAA)20 | (GAAA)13N8(GAAA)19 | 31 | 1798 |
| DYF399S1 | (GAAA)13N8(GAAA)15 | (GAAA)13N8(GAAA)16 | 51 | 1813 |
| DYF399S1 | (GAAA)13N7(GAAA)21 | (GAAA)13N8(GAAA)20 | 19 | 1841 |
| DYF399S1 | (GAAA)13N8(GAAA)22 | (GAAA)13N7(GAAA)21 | 55 | 1844 |
| DYF399S1 | (GAAA)13N8(GAAA)22 | (GAAA)13N8(GAAA)23 | 59 | 1857 |
| DYF399S1 | (GAAA)13N8(GAAA)17 | (GAAA)13N8(GAAA)16 | 53 | 1869 |
| DYF399S1 | (GAAA)13N8(GAAA)16 | (GAAA)13N8(GAAA)15 | 73 | 1884 |
| DYF399S1 | (GAAA)13N7(GAAA)18 | (GAAA)13N8(GAAA)19 | 52 | 1891 |
| DYF399S1 | (GAAA)13N7(GAAA)21 | (GAAA)13N8(GAAA)20 | 52 | 1891 |
| DYF399S1 | (GAAA)13N8(GAAA)16 | (GAAA)13N8(GAAA)15 | 55 | 1909 |
| DYF399S1 | (GAAA)13N7(GAAA)19 | (GAAA)13N7(GAAA)18 | 60 | 1913 |
| DYF399S1 | (GAAA)13N8(GAAA)17 | (GAAA)13N8(GAAA)16 | 50 | 1941 |
| DYF401S1 | (AAGG)3(AAGC)1(AAGG)1(AAGG)3N8(AAGG)3 | (AAGG)3(AAGC)1(AAGG)3N8(AAGG)3N8(AAGG)3 | 37 | 36 |
| DYF401S1 | (AAGG)1(AAGC)1(AAGC)3N13(AA-AG)15G(AAGG)6 | | | |
| DYF401S1 | (AAGG)3(AAGC)1(AAGG)3N39(AAGG)3N8(AAGG)3 | (AAGG)1(AAGC)1(AAGG)3N39(AAGG)3N8(AAGG)3 | 34 | 372 |
| DYF401S1 | (AAAG)1(AAGC)1(AAGC)3N13(AAAG)17G(AAGG)6 | (AAAG)1(AAGC)1(AAGG)3N13(AAAG)15G(AAGG)6 | | |
| DYF401S1 | (AAGG)3(AAGC)1(AAGG)3N39(AAGG)3N8(AAGG)3 | (AAGG)3(AAGC)1(AAGG)3N39(AAGG)3N8(AAGG)3 | 28 | 674 |
| DYF401S1 | (AAAG)1(AAGG)3N13(AAAG)15G(AAGG)6 | (AAAG)1(AAGG)3N13(AAAG)15G(AAGG)6 | | |
| DYF401S1 | (AAGG)3(AAGC)3N08(AAGG)3N8(AAGG)3 | (AAGG)3(AAGC)1(AAGG)3N39(AAGG)3N8(AAGG)3 | 21 | 769 |
| DYF401S1 | (AAAG)1(AAGG)3N13(AAAG)15G(AAGG)6 | (AAAG)1(AAGC)1(AAGG)3N13(AAAG)15G(AAGG)6 | | |
| DYF401S1 | (AAGG)3(AAGC)1(AAGG)3N39(AAGG)3N8(AAGG)3 | (AAGG)3(AAGC)1(AAGG)3N39(AAGG)3N8(AAGG)3 | Unknown | 1241 |
| DYF401S1 | (AAAG)1 (AAGG)3N13(AAAG)15G(AAGG)6 | (AAAG)1(AAGG)3N13(AAAG)14G(AAGG)6 | | |
| DYF401S1 | (AAGG)3(AAGC)3N8(AAGG)3N8(AAGG)3 | (AAGG)3(AAGC)1(AAGG)3N39(AAGG)3N8(AAGG)3 | 56 | 1272 |
| DYF401S1 | (AAAG)1 (AAGG)3N13(AAAG)16G(AAGG)6 | (AAAG)1(AAGG)3N13(AAAG)15G(AAGG)6 | | |
| DYF401S1 | (AAGG)3(AAGC)3N8(AAGG)3N8(AAGG)3 | (AAGG)3(AAGC)1(AAGG)3N8(AAGG)3N8(AAGG)3 | 31 | 1516 |
| DYF401S1 | (AAAG)1 (AAGG)3N13(AAAG)16G(AAGG)6 | (AAAG)1(AAGG)3M39(AAGG)3N13(AAAG)15G(AAGG)6 | | |
| DYF401S1 | (AAGG)3(AAGC)1(AAGG)3N39(AAGG)3N8(AAGG)3 | (AAGG)3(AAGG)3N13(AAAG)15G(AAGG)6 | 28 | 1734 |
| DYF401S1 | (AAAG)1 (AAGG)3N13(AAAG)17G(AAGG)6 | (AAAG)1(AAGG)3N13(AAAG)15G(AAGG)6 | | |
| DYF403S1a | 342 | 338 | 20 | 73 |
| DYF403S1a | 321 | 316 | 32 | 128 |
| DYF403S1a | 315 | 321 | 27 | 132 |
| DYF403S1a | 316,329,358 | 321,325,334 | 17 | 175 |
| DYF403S1a | 346 | 350 | 37 | 186 |
| DYF403S1a | 342 | 346 | 32 | 201 |
| DYF403S1a | 354 | 350 | 37 | 406 |
| DYF403S1a | 360 | 354 | 20 | 423 |
| DYF403S1a | 342 | 346 | 19 | 546 |
| DYF403S1a | 325 | 329 | 24 | 681 |

FIGURE 6 [con't]

| Locus | Father Allele | Son Allele | Father's Age | Father Reference # |
|---|---|---|---|---|
| DYF403S1a | 325 | 321 | 39 | 749 |
| DYF403S1a | 334 | 336 | 22 | 817 |
| DYF403S1a | 321 | 342 | 28 | 841 |
| DYF403S1a | 336 | 342 | 37 | 904 |
| DYF403S1a | 308 | 312 | 34 | 911 |
| DYF403S1a | 342 | 346 | 18 | 943 |
| DYF403S1a | 312 | 316 | 20 | 977 |
| DYF403S1a | 342 | 346 | 46 | 1030 |
| DYF403S1a | 321 | 316 | 21 | 1053 |
| DYF403S1a | 350 | 354 | 39 | 1071 |
| DYF403S1a | 342 | 346 | 27 | 1085 |
| DYF403S1a | 325 | 329 | 44 | 1110 |
| DYF403S1a | 342 | 338 | 22 | 1323 |
| DYF403S1a | 346 | 350 | 36 | 1336 |
| DYF403S1a | 312 | 316 | Unknown | 1353 |
| DYF403S1a | 354 | 350 | 45 | 1364 |
| DYF403S1a | 342 | 338 | 41 | 1378 |
| DYF403S1a | 342 | 338 | 42 | 1411 |
| DYF403S1a | 346 | 350 | 42 | 1441 |
| DYF403S1a | 338 | 342 | 24 | 1480 |
| DYF403S1a | 325 | 329 | 40 | 1531 |
| DYF403S1a | 346 | 342 | 28 | 1554 |
| DYF403S1a | 312 | 316 | 33 | 1591 |
| DYF403S1a | 321 | 316 | 25 | 1634 |
| DYF403S1a | 342 | 334 | 36 | 1643 |
| DYF403S1a | 329 | 334 | 24 | 1704 |
| DYF403S1a | 312 | 316 | 26 | 1725 |
| DYF403S1a | 312 | 316 | 40 | 1785 |
| DYF403S1a | 312 | 316 | 31 | 1798 |
| DYF403S1a | 329 | 334 | 43 | 1818 |
| DYF403S1a | 346 | 342 | 27 | 1840 |
| DYF403S1a | 346 | 350 | 43 | 1883 |
| DYF403S1a | 329 | 334 | 57 | 1896 |
| DYF403S1a | 334 | 321 | 64 | 1912 |
| DYF403S1a | 346 | 342 | 50 | 1941 |
| DYF403S1a | 325,346 | 329,338 | 58 | 1947 |
| DYF403S1b | 50 | 49 | 40 | 28 |
| DYF403S1b | 46.1 | 45.1 | 32 | 115 |
| DYF403S1b | 50 | 49 | 33 | 137 |
| DYF403S1b | 49 | 47 | 17 | 175 |

FIGURE 6 [con't]

| Locus | Father Allele | Son Allele | Father's Age | Father Reference # |
|---|---|---|---|---|
| DYF403S1b | 51 | 50 | 53 | 453 |
| DYF403S1b | 51 | 50 | 18 | 470 |
| DYF403S1b | 50 | 49 | 39 | 743 |
| DYF403S1b | 53 | 60 | 19 | 916 |
| DYF403S1b | 52 | 53 | 21 | 1090 |
| DYF403S1b | 50 | 49 | Unknown | 1269 |
| DYF403S1b | 52 | 51 | 25 | 1391 |
| DYF403S1b | 46.1 | 47.1 | 54 | 1447 |
| DYF403S1b | 49 | 50 | Unknown | 1679 |
| DYF403S1b | 48 | 49 | 23 | 1761 |
| DYF403S1b | 45 | 46 | 56 | 1847 |
| DYF403S1b | 46.1 | 47.1 | 54 | 1951 |
| DYF404S1 | (TTC)15N42(TTC)3 | (TTC)16N42(TTC)3 | 28 | 9 |
| DYF404S1 | (TTC)16N42(TTC)3 | (TTC)14N42(TTC)3 | 26 | 376 |
| DYF404S1 | (TTC)16N42(TTC)3 | (TTC)17N42(TTC)3 | 28 | 415 |
| DYF404S1 | (TTC)16N42(TTC)3 | (TTC)17N42(TTC)3 | 29 | 481 |
| DYF404S1 | (TTC)16N42(TTC)3 | (TTC)17N42(TTC)3 | 20 | 706 |
| DYF404S1 | (TTC)15N42(TTC)3 | (TTC)16N42(TTC)3 | 22 | 757 |
| DYF404S1 | (TTC)16N42(TTC)3 | (TTC)17N42(TTC)3 | 18 | 910 |
| DYF404S1 | (TTC)16N42(TTC)3 | (TTC)17N42(TTC)3 | 32 | 1007 |
| DYF404S1 | (TTC)14N42(TTC)3 | (TTC)15N42(TTC)3 | 23 | 1012 |
| DYF404S1 | (TTC)16N42(TTC)3 | (TTC)17N42(TTC)3 | 27 | 1049 |
| DYF404S1 | (TTC)18N42(TTC)3 | (TTC)17N42(TTC)3 | 31 | 1084 |
| DYF404S1 | (TTC)14N42(TTC)3 | (TTC)15N42(TTC)3 | 38 | 1114 |
| DYF404S1 | (TTC)16N42(TTC)3 | (TTC)15N42(TTC)3 | 21 | 1396 |
| DYF404S1 | (TTC)16N42(TTC)3 | (TTC)17N42(TTC)3 | 33 | 1545 |
| DYF404S1 | (TTC)15N42(TTC)3 | (TTC)14N42(TTC)3 | 40 | 1576 |
| DYF404S1 | (TTC)17N42(TTC)3 | (TTC)18N42(TTC)3 | 36 | 1655 |
| DYF404S1 | (TTC)17N42(TTC)3 | (TTC)16N42(TTC)3 | 28 | 1657 |
| DYF404S1 | (TTC)16N42(TTC)3 | (TTC)17N42(TTC)3 | 36 | 1667 |
| DYF404S1 | (TTC)16N42(TTC)3 | (TTC)14N42(TTC)3 | 19 | 1739 |
| DYF404S1 | (TTC)16N42(TTC)3 | (TTC)17N42(TTC)3 | 50 | 1881 |
| DYF404S1 | (TTC)17N42(TTC)3 | (TTC)18N42(TTC)3 | 60 | 1913 |
| DYF405S1 | (GGAA)11N115(GGAA)(GAAA)1(GGAA)3 | (GGAA)12N115(GGAA)(GAAA)1(GGAA)3 | 31 | 438 |
| DYF405S1 | (GGAA)14N115(GGAA)(GAAA)1(GGAA)3 | (GGAA)13N115(GGAA)2(GAAA)1(GGAA)3 | 34 | 629 |
| DYF406S1 | (TATC)12 | (TATC)11 | 26 | 234 |
| DYF406S1 | (TATC)11 | (TATC)10 | 47 | 347 |
| DYF406S1 | (TATC)12 | (TATC)13 | 35 | 513 |
| DYF406S1 | (TATC)11 | (TATC)10 | 33 | 1011 |
| DYF406S1 | (TATC)12 | (TATC)13 | 41 | 1122 |

FIGURE 6 [con't]

| Locus | Father Allele | Son Allele | Father's Age | Father Reference # |
|---|---|---|---|---|
| DYF406S1 | (TATC)12 | (TATC)13 | Unknown | 1263 |
| DYF41GS1 | (AAAT)9 | (AAAT)10 | Unknown | 1457 |
| DYF410S1 | (AAAT)9 | (AAAT)10 | 21 | 1667 |
| DYS19 | (TAGA)3(TAGG)11(TAGA)13 | (TAGA)3(TAGG)11(TAGA)14 | 46 | 472 |
| DYS19 | (TAGA)3(TAGG)11(TAGA)11 | (TAGA)3(TAGG)11(TAGA)12 | 43 | 472 |
| DYS19 | (TAGA)3(TAGG)11(TAGA)14 | (TAGA)3(TAGG)11(TAGA)13 | 34 | 726 |
| DYS19 | (TAGA)3(TAGG)11(TAGA)14 | (TAGA)3(TAGG)11(TAGA)15 | 31 | 927 |
| DYS19 | (TAGA)3(TAGG)11(TAGA)12 | (TAGA)3(TAGG)11(TAGA)13 | Unknown | 1224 |
| DYS19 | (TAGA)3(TAGG)11(TAGA)14 | (TAGA)3(TAGG)11(TAGA)13 | 29 | 1257 |
| DYS19 | (TAGA)3(TAGG)11(TAGA)14 | (TAGA)3(TAGG)11(TAGA)13 | 24 | 1767 |
| DYS385a | (AAGG)4N14(AAAG)3N28(AAGGN(GA)13 | (AAGG)4N14(AAAG)3N28(AAGG)6(GA)13 | 22 | 502 |
| DYS385a | (AAGG)4N14(AAAG)3N29(AAGG)6(GA)13 | (AAGG)4N14(AAAG)3N29(AAGG)6(GA)14 | 30 | 1060 |
| DYS385a | (AAGG)4N14(AAAG)3N29(AAGG)6(GA)14 | (AAGG)4N14(AAAG)3N29(AAGG)6(GA)15 | 60 | 1695 |
| DYS385b | (AAGG)4N14(AAAG)3N29(AAGG)6(GA)15 | (AAGG)4N14(AAAG)3N29(AAGG)6(GA)16 | 39 | 501 |
| DYS385b | (AAGG)4N14(AAAG)3N29(AAGG)6(GA)15 | (AAGG)4N14(AAAG)3N29(AAGG)6(GA)16 | 48 | 781 |
| DYS385b | (AAGG)4N14(AAAG)3N29(AAGG)6(GA)14 | (AAGG)4N14(AAAG)3N29(AAGG)6(GA)15 | 24 | 835 |
| DYS385b | (AAGG)4N14(AAAG)3N29(AAGG)6(GA)14 | (AAGG)4N14(AAAG)3N29(AAGG)6(GA)15 | 21 | 836 |
| DYS385b | (AAGG)4N14(AAAG)3N29(AAGG)6(GA)16 | (AAGG)4N14(AAAG)3N29(AAGG)6(GA)15 | 23 | 1060 |
| DYS385b | (AAGG)4N14(AAAG)3N29(AAGG)6(GA)11 | (AAGG)4N14(AAAG)3N29(AAGG)6(GA)12 | 52 | 1527 |
| DYS391 | (TCTG)3(TCTA)12 | (TCTG)3(TCTA)11 | 32 | 12 |
| DYS391 | (TCTG)3(TCTA)11 | (TCTG)3(TCTA)10 | 23 | 96 |
| DYS391 | (TCTG)3(TCTA)10 | (TCTG)3(TCTA)11 | 23 | 207 |
| DYS391 | (TCTG)3(TCTA)11 | (TCTG)3(TCTA)10 | 26 | 214 |
| DYS391 | (TCTG)3(TCTA)9 | (TCTG)3(TCTA)10 | 23 | 1119 |
| DYS391 | (TCTG)3(TCTA)10 | (TCTG)3(TCTA)11 | Unknown | 1265 |
| DYS391 | (TCTG)3(TCTA)10 | (TCTG)3(TCTA)9 | 39 | 1700 |
| DYS391 | (TCTG)3(TCTA)10 | (TCTG)3(TCTA)11 | 46 | 1946 |
| DYS391 | (TCTG)3(TCTA)11 | (TCTG)3(TCTA)10 | 35 | 1966 |
| DYS393 | (TCTG)5(TCTA)12N28(TCTG)3(TCTA)10 | (TCTG)5(TCTA)11N28(TCTG)3(TCTA)10 | 32 | 401 |
| DYS393 | (TCTG)5(TCTA)14N28(TCTG)3(TCTA)11 | (TCTG)5(TCTA)13N28(TCTG)3(TCTA)11 | 36 | 519 |
| DYS393 | (TCTG)5(TCTA)13N28(TCTG)3(TCTA)11 | (TCTG)5(TCTA)12N28(TCTG)3(TCTA)11 | 21 | 721 |

FIGURE 6 [con't]

| Locus | Father Allele | Son Allele | Father's Age | Father Reference # |
|---|---|---|---|---|
| DYS389II | (TCTG)4(TCTA)13N28(TCTG)3(TCTA)10 | (TCTG)4(TCTA)13N28(TCTG)3(TCTA)10 | Unknown | 1221 |
| DYS389II | (TCTG)5(TCTA)12N28(TCTG)3(TCTA)9 | (TCTG)5(TCTA)13N28(TCTG)3(TCTA)9 | 24 | 1312 |
| DYS389II | (TCTG)5(TCTA)13N28(TCTG)3(TCTA)9 | (TCTG)5(TCTA)12N28(TCTG)3(TCTA)9 | 54 | 1942 |
| DYS390 | (TCTG)8(TCTA)12(TCTG)1(TCTG)4 | (TCTG)8(TCTA)11(TCTG)1(TCTG)4 | 30 | 975 |
| DYS390 | (TCTG)8(TCTA)12(TCTG)1(TCTG)4 | (TCTG)8(TCTA)11(TCTG)1(TCTG)4 | 20 | 1148 |
| DYS391 | (TCTG)3(TCTA)10 | (TCTG)3(TCTA)10 | 22 | 240 |
| DYS391 | (TCTG)3(TCTA)10 | (TCTG)3(TCTA)11 | 22 | 699 |
| DYS391 | (TCTG)3(TCTA)11 | (TCTG)3(TCTA)10 | 31 | 881 |
| DYS391 | (TCTG)3(TCTA)11 | (TCTG)3(TCTA)12 | 50 | 884 |
| DYS391 | (TCTG)3(TCTA)11 | (TCTG)3(TCTA)12 | 42 | 1441 |
| DYS392 | (TAT)13 | (TAT)14 | 60 | 1802 |
| DYS393 | (AGAT)14 | (AGAT)13 | 22 | 1028 |
| DYS393 | (AGAT)13 | (AGAT)14 | 42 | 1411 |
| DYS393 | (AGAT)14 | (AGAT)15 | 51 | 1852 |
| DYS426 | (TGT)13 | (TGT)12 | 31 | 1044 |
| DYS426 | (TGT)12 | (TGT)13 | 41 | 1476 |
| DYS435 | (TGGA)11 | (TGGA)10 | 19 | 916 |
| DYS437 | (TCTA)8(TCTG)12(TCTA)4 | (TCTA)9(TCTG)12(TCTA)4 | 32 | 1024 |
| DYS437 | (TCTA)9(TCTG)12(TCTA)4 | (TCTA)8(TCTG)12(TCTA)4 | 53 | 1669 |
| DYS438 | (TTTC)12 | (TTTC)10, (TTTC)12 | 46 | 23 |
| DYS439 | (GATA)3N32(GATA)10 | (GATA)3N32(GATA)11 | 24 | 516 |
| DYS439 | (GATA)3N32(GATA)13 | (GATA)3N32(GATA)14 | 36 | 617 |
| DYS439 | (GATA)3N32(GATA)13 | (GATA)3N32(GATA)12 | 23 | 620 |
| DYS439 | (GATA)3N32(GATA)13 | (GATA)3N32(GATA)12 | 40 | 1204 |
| DYS439 | (GATA)3N32(GATA)14 | (GATA)3N32(GATA)13 | 37 | 1211 |
| DYS441 | (TTCC)14 | (TTCC)15 | 31 | 1463 |
| DYS442 | (GATA)13(GACA)3 | (GATA)12(GACA)3 | 38 | 589 |
| DYS442 | (GATA)13(GACA)3 | (GATA)12(GACA)3 | 32 | 213 |
| DYS442 | (GATA)13(GACA)3 | (GATA)12(GACA)3 | 28 | 354 |
| DYS442 | (GATA)15(GACA)3 | (GATA)14(GACA)3 | 45 | 409 |
| DYS442 | (GATA)15(GACA)3 | (GATA)14(GACA)3 | 28 | 425 |
| DYS442 | (GATA)16(GACA)3 | (GATA)15(GACA)3 | 30 | 533 |
| DYS442 | (GATA)14(GACA)3 | (GATA)15(GACA)3 | 26 | 775 |
| DYS442 | (GATA)15(GACA)3 | (GATA)14(GACA)3 | 27 | 853 |
| DYS442 | (GATA)14(GACA)3 | (GATA)15(GACA)3 | 30 | 1181 |
| DYS442 | (GATA)13(GACA)3 | (GATA)12(GACA)3 | 16 | 1238 |
| DYS442 | (GATA)12(GACA)3 | (GATA)11(GACA)3 | 39 | 1239 |
| DYS442 | (GATA)14(GACA)3 | (GATA)13(GACA)3 | Unknown | 1245 |
| DYS442 | (GATA)12(GACA)3 | (GATA)13(GACA)3 | 28 | 1587 |
| DYS442 | (GATA)12(GACA)3 | (GATA)11(GACA)3 | 75 | 1884 |

FIGURE 6 [con't]

| Locus | Father Allele | Son Allele | Father's Age | Father Reference # |
|---|---|---|---|---|
| DYS442 | (GATA)13(ACA)3 | (GATA)13(ACA)3 | 51 | 1888 |
| DYS443 | (TTCC)13(CTT)3 | (TTCC)14(CTT)3 | 18 | 69 |
| DYS443 | (TTCC)14(CTT)3 | (TTCC)15(CTT)3 | 35 | 97 |
| DYS443 | (TTCC)14(CTT)3 | (TTCC)15(CTT)3 | 28 | 473 |
| DYS444 | (TAGA)12 | (TAGA)11 | 46 | 23 |
| DYS444 | (TAGA)13 | (TAGA)12 | 20 | 73 |
| DYS444 | (TAGA)13 | (TAGA)12 | 30 | 448 |
| DYS444 | (TAGA)14 | (TAGA)15 | 25 | 673 |
| DYS444 | (TAGA)15 | (TAGA)14 | 30 | 1057 |
| DYS444 | (TAGA)15 | (TAGA)14 | 22 | 1131 |
| DYS444 | (TAGA)15 | (TAGA)14 | 28 | 1294 |
| DYS444 | (TAGA)12 | (TAGA)13 | 35 | 1680 |
| DYS445 | (TTTA)10 | (TTTA)11 | 51 | 1613 |
| DYS445 | (TTTA)11 | (TTTA)12 | 57 | 464 |
| DYS445 | (TTTA)13 | (TTTA)14 | 22 | 636 |
| DYS446 | (TCTCT)13 | (TCTCT)14 | 21 | 1448 |
| DYS446 | (TCTCT)11 | (TCTCT)10 | 41 | 313 |
| DYS446 | (TCTCT)12 | (TCTCT)11 | 51 | 1482 |
| DYS446 | (TCTCT)12 | (TCTCT)13 | 55 | 1644 |
| DYS447 | (TATA)6(TTAT)1(TTAT)1(TATA)6(TTAT)1(TATA)7 | (TATA)6(TTAT)1(TATA)6(TTAT)1(TATA)7 | 53 | 1893 |
| DYS447 | (TATA)7(TTAT)1(TATA)10(TTAT)1(TATA)7 | (TATA)2(TTAT)1(TATA)9(TTAT)1(TATA)7 | 33 | 690 |
| DYS447 | (TATA)6(TTAT)1(TATA)8(TTAT)1(TATA)9 | (TATA)6(TTAT)1(TATA)8(TTAT)1(TATA)8 | 47 | 1302 |
| DYS449 | (TTCT)15N2(TTCT)3N12(TTCT)16 | (TTCT)16N22(TTCT)3N12(TTCT)15 | 56 | 1677 |
| DYS449 | (TTCT)16N22(TTCT)3N12(TTCT)19 | (TTCT)14N22(TTCT)3N12(TTCT)19 | 29 | 76 |
| DYS449 | (TTCT)16N22(TTCT)3N12(TTCT)17 | (TTCT)17N22(TTCT)3N12(TTCT)17 | 27 | 170 |
| DYS449 | (TTCT)16N22(TTCT)3N12(TTCT)18 | (TTCT)16N22(TTCT)3N12(TTCT)17 | 33 | 251 |
| DYS449 | (TTCT)15N22(TTCT)3N12(TTCT)18 | (TTCT)15N22(TTCT)3N12(TTCT)19 | 38 | 449 |
| DYS449 | (TTCT)15N22(TTCT)3N12(TTCT)23 | (TTCT)16N22(TTCT)3N12(TTCT)13 | 39 | 492 |
| DYS449 | (TTCT)15N22(TTCT)3N12(TTCT)18 | (TTCT)16N22(TTCT)3N12(TTCT)17 | 35 | 531 |
| DYS449 | (TTCT)15N22(TTCT)3N12(TTCT)17 | (TTCT)15N22(TTCT)3N12(TTCT)15 | 34 | 563 |
| DYS449 | (TTCT)15N22(TTCT)3N12(TTCT)18 | (TTCT)16N22(TTCT)3N12(TTCT)17 | 21 | 786 |
| DYS449 | (TTCT)15N22(TTCT)3N12(TTCT)14 | (TTCT)16N22(TTCT)3N12(TTCT)13 | 25 | 840 |
| DYS449 | (TTCT)15N22(TTCT)3N12(TTCT)18 | (TTCT)15N22(TTCT)3N12(TTCT)17 | 22 | 894 |
| DYS449 | (TTCT)15N22(TTCT)3N12(TTCT)17 | (TTCT)15N22(TTCT)3N12(TTCT)16 | 37 | 904 |
| DYS449 | (TTCT)15N22(TTCT)3N12(TTCT)15 | (TTCT)16N22(TTCT)3N12(TTCT)14 | 33 | 966 |
| DYS449 | (TTCT)15N22(TTCT)3N12(TTCT)14 | (TTCT)16N22(TTCT)3N12(TTCT)16 | 24 | 1167 |
| DYS449 | (TTCT)15N22(TTCT)3N12(TTCT)14 | (TTCT)16N22(TTCT)3N12(TTCT)14 | 22 | 1349 |
| DYS449 | (TTCT)15N22(TTCT)3N12(TTCT)16 | (TTCT)19N22(TTCT)3N12(TTCT)14 | 45 | 1364 |
| DYS449 | (TTCT)14N22(TTCT)3N12(TTCT)14 | (TTCT)14N22(TTCT)3N12(TTCT)15 | 37 | 1418 |
| DYS449 | (TTCT)14N22(TTCT)3N12(TTCT)14 | (TTCT)14N22(TTCT)3N12(TTCT)15 | 21 | 1505 |

FIGURE 6 [con't]

| Locus | Father Allele | Son Allele | Father's Age | Father Reference # |
|---|---|---|---|---|
| DYS449 | (TCT)18N22(TCT)3N12(TCT)15 | (TCT)14N22(TCT)3N12(TCT)15 | 22 | 1526 |
| DYS449 | (TCT)14N22(TCT)3N12(TCT)16 | (TCT)14N22(TCT)3N12(TCT)16 | 54 | 1845 |
| DYS450 | (TTTA)6N12(TTTA)3 | (TTTA)6N12(TTTA)3 | 44 | 1619 |
| DYS452 | (TATAC)12(CATAC)1(TATAC)12N20(TATAC)3(CATAC)1(TATAC)3 | (TATAC)13(CATAC)1(TATAC)12N20(TATAC)3(CATAC)1(TATAC)3 | 17 | 967 |
| DYS452 | (TATAC)11(CATAC)1(TATAC)12N20(TATAC)3(CATAC)1(TATAC)3 | (TATAC)12(CATAC)1(TATAC)12N20(TATAC)3(CATAC)1(TATAC)3 | 28 | 971 |
| DYS452 | (TATAC)11(CATAC)1(TATAC)12N20(TATAC)3(CATAC)1(TATAC)3 | (TATAC)11(CATAC)1(TATAC)12N20(TATAC)3(CATAC)1(TATAC)3 | 33 | 1046 |
| DYS452 | (TATAC)9(CATAC)1(TATAC)12N20(TATAC)3(CATAC)1(TATAC)3 | (TATAC)9(CATAC)1(TATAC)12N20(TATAC)3(CATAC)1(TATAC)3 | 41 | 1453 |
| DYS452 | (TATAC)8(CATAC)1(TATAC)14N20(TATAC)3(CATAC)1(TATAC)3 | (TATAC)8(CATAC)1(TATAC)13N20(TATAC)3(CATAC)1(TATAC)3 | 55 | 1858 |
| DYS456 | (AGAT)15 | (AGAT)15 | 34 | 308 |
| DYS456 | (AGAT)16 | (AGAT)17 | 32 | 401 |
| DYS456 | (AGAT)15 | (AGAT)16 | 28 | 525 |
| DYS456 | (AGAT)16 | (AGAT)17 | 24 | 560 |
| DYS456 | (AGAT)15 | (AGAT)16 | 35 | 830 |
| DYS456 | (AGAT)17 | (AGAT)15 | 20 | 1037 |
| DYS456 | (AGAT)17 | (AGAT)16 | Unknown | 1333 |
| DYS456 | (AGAT)16 | (AGAT)17 | 29 | 1790 |
| DYS458 | (GAAA)18 | (GAAA)17 | 26 | 307 |
| DYS458 | (GAAA)18 | (GAAA)19 | 41 | 313 |
| DYS458 | (GAAA)17 | (GAAA)18 | 28 | 466 |
| DYS458 | (GAAA)17 | (GAAA)18 | 27 | 734 |
| DYS458 | (GAAA)16 | (GAAA)15 | 24 | 771 |
| DYS458 | (GAAA)17 | (GAAA)18 | 29 | 826 |
| DYS458 | (GAAA)15 | (GAAA)16 | Unknown | 1063 |
| DYS458 | (GAAA)16 | (GAAA)15 | 19 | 1132 |
| DYS458 | (GAAA)17 | (GAAA)16 | 34 | 1426 |
| DYS458 | (GAAA)16 | (GAAA)17 | 37 | 1454 |
| DYS458 | (GAAA)17 | (GAAA)16 | 19 | 1506 |
| DYS458 | (GAAA)18 | (GAAA)17 | Unknown | 1613 |
| DYS458 | (GAAA)18 | (GAAA)19 | 64 | 1912 |
| DYS459 | (ATTT)10 | (ATTT)9 | 65 | 1920 |
| DYS459 | (ATTT)9 | (ATTT)10 | 29 | 246 |
| DYS459 | (ATTT)10 | (ATTT)9 | 26 | 573 |
| DYS459 | (ATTT)10 | (ATTT)11 | 43 | 928 |
| DYS460 | (TAGA)13 | (TAGA)12 | 27 | 1195 |
|  |  |  | 27 | 41 |

FIGURE 6 [con't]

| Locus | Father Allele | Son Allele | Father's Age | Father Reference # |
|---|---|---|---|---|
| DYS460 | (TAGA)9 | (TAGA)10 | 29 | 481 |
| DYS460 | (TAGA)11 | (TAGA)10 | 35 | 522 |
| DYS460 | (TAGA)12 | (TAGA)11 | 24 | 560 |
| DYS460 | (TAGA)11 | (TAGA)10 | 27 | 777 |
| DYS460 | (TAGA)11 | (TAGA)10 | 30 | 1062 |
| DYS460 | (TAGA)12 | (TAGA)11 | 33 | 1112 |
| DYS460 | (TAGA)11 | (TAGA)10 | 29 | 1601 |
| DYS460 | (TAGA)10 | (TAGA)11 | 21 | 1728 |
| DYS460 | (TAGA)13 | (TAGA)12 | 28 | 1734 |
| DYS460 | (TAGA)11 | (TAGA)10 | 23 | 1876 |
| DYS462 | (CATA)11 | (CATA)10 | 18 | 692 |
| DYS462 | (CATA)13 | (CATA)12 | 30 | 1435 |
| DYS462 | (CATA)11 | (CATA)10 | 30 | 1502 |
| DYS462 | (CATA)11 | (CATA)12 | 64 | 1612 |
| DYS463 | (AAAGG)6(AAGGG)15 | (AAAGG)6(AAGGG)16 | 36 | 327 |
| DYS463 | (AAAGG)6(AAGGG)13 | (AAAGG)6(AAGGG)14 | 54 | 1447 |
| DYS464 | (CCTT)18N46(CCTT)3N8(CCTT)4 | (CCTT)17N46(CCTT)3N8(CCTT)4 | 25 | 4 |
| DYS464 | (CCTT)18N46(CCTT)3N8(CCTT)4 | (CCTT)14N46(CCTT)3N8(CCTT)4 | 16 | 470 |
| DYS464 | (CCTT)17N46(CCTT)3N8(CCTT)4 | (CCTT)16N46(CCTT)3N8(CCTT)4 | 25 | 513 |
| DYS464 | (CCTT)16N46(CCTT)3N8(CCTT)4 | (CCTT)13N46(CCTT)3N8(CCTT)4 | 53 | 760 |
| DYS464 | (CCTT)13N46(CCTT)3N8(CCTT)4 | (CCTT)14N46(CCTT)3N8(CCTT)4 | 18 | 847 |
| DYS464 | (CCTT)18N46(CCTT)3N8(CCTT)4 | (CCTT)16N46(CCTT)3N8(CCTT)4 | 19 | 900 |
| DYS464 | (CCTT)16N46(CCTT)3N8(CCTT)4 | (CCTT)15N46(CCTT)3N8(CCTT)4 | 20 | 1185 |
| DYS464 | (CCTT)17N46(CCTT)3N8(CCTT)4 | (CCTT)16N46(CCTT)3N8(CCTT)4 | 31 | 1339 |
| DYS464 | (CCTT)15N46(CCTT)3N8(CCTT)4 | (CCTT)16N46(CCTT)3N8(CCTT)4 | 22 | 1526 |
| DYS464 | (CCTT)18N46(CCTT)3N8(CCTT)4 | (CCTT)16N46(CCTT)3N8(CCTT)4 | 43 | 1640 |
| DYS464 | (CCTT)17N46(CCTT)3N8(CCTT)4 | (CCTT)16N46(CCTT)3N8(CCTT)4 | 19 | 1784 |
| DYS464 | (CCTT)18N46(CCTT)3N8(CCTT)4 | (CCTT)17N46(CCTT)3N8(CCTT)4 | 56 | 1892 |
| DYS464 | (CTG)4N44(CCTT)3N40(CCT)4N8(CTC)4(CTT)9(ATTCAT)8 | (CTG)4N44(CCTT)3N40(CCT)4N8(CCT)4(CTT)9(ATTCAT)8 | 29 | 1743 |
| DYS468 | (CTG)4N44(CCTT)3N40(CCT)4N9(CTT)5(CTT)3N35(CCT)4N8(CTC)4(CTT)9(ATTCAT)9 | (CTG)4N44(CCTT)3N40(CCT)4N8(CTC)4(CTT)9(ATTCAT)8 | 60 | 1802 |
| DYS469 | (CCTT)3N38(CTT)4(GTT)1(CTT)20T(CTT)3N17(CTT)5(CCT)4N8(CTT)3N12(CTT)4N12(CTT)3N12(CCTT)4N9(CTT)3N17(CTT)5N37(CCT)3 | (CTT)3N39(CTT)4(GTT)1(CTT)20T(CTT)3N17(CTT)5(CCT)4N8(CTT)3N12(CTT)4N12(CTT)3N12(CCTT)4N9(CTT)3N17(CTT)5N37(CCT)3 | 24 | 107 |
| DYS469 | M12(CTT)4N12(CTT)3N12(CCTT)4N9(CTT)3N17(CTT)3N12(CTT)4N12(CTT)3N12(CCTT)4N9(CTT)3N17(CTT)3N37(CCT)3 | N12(CTT)4N12(CTT)3N12(CCTT)4N9(CTT)3N17(CTT)5(CCT)4N8(CTT)3N12(CTT)4N12(CTT)3N12(CCTT)4N9(CTT)3N17(CTT)5N37(CTT)3 | 21 | 769 |

FIGURE 6 [con't]

| Locus | Father Allele | Son Allele | Father's Age | Father Reference # |
|---|---|---|---|---|
| DYS469 | (CTT)3N39(CTT)4(GTT)1(CTT)1B(CTT)3N17(CTT)5 N37(CTT)3 N12(CTT)4N12(CTT)15(CCT)3(CCT)4N9(CTT)3C CT)3 | (CTT)3N38(CTT)4(GTT)1(CTT)1BT(CTT)3N17(CTT)5 N37(CTT)3 N12(CTT)4N12(CTT)15(CCT)3(CCT)4N9(CTT)3C CT)3 | 29 | 1491 |
| DYS469 | (CTT)3N39(CTT)4(GTT)1(CTT)16T(CTT)3N17(CTT)5 N37(CTT)3 N12(CTT)4N12(CTT)3N12(CCT)4N9(CTT)3C CT)3 | (CTT)3N39(CTT)4(GTT)1(CTT)15T(CTT)3N17(CTT)5 N37(CTT)3 N12(CTT)4N12(CTT)3N12(CCT)4N6(CTT)3C CT)3 | 29 | 1863 |
| DYS476 | (TGA)11 | (TGA)12 | 59 | 1867 |
| DYS481 | (CTT)28 | (CTT)29 | 30 | 99 |
| DYS481 | (CTT)22 | (CTT)23 | 32 | 655 |
| DYS481 | (CTT)30 | (CTT)29 | 24 | 778 |
| DYS481 | (CTT)32 | (CTT)31 | 17 | 945 |
| DYS481 | (CTT)31 | (CTT)30 | 24 | 1370 |
| DYS481 | (CTT)23 | (CTT)31 | 42 | 1411 |
| DYS481 | (CTT)25 | (CTT)24 | 36 | 1872 |
| DYS481 | (CTT)22 | (CTT)23 | 54 | 1895 |
| DYS484 | (AAT)13N12(AAT)3(TAT)3 | (AAT)11N12(AAT)3(TAT)3 | 22 | 45 |
| DYS484 | (AAT)13N12(AAT)3(TAT)3 | (AAT)14N12(AAT)3(TAT)3 | 35 | 875 |
| DYS484 | (AAT)12N12(AAT)3(TAT)3 | (AAT)13N12(AAT)3(TAT)3 | 25 | 1213 |
| DYS484 | (AAT)12N12(AAT)3(TAT)3 | (AAT)10N12(AAT)3(TAT)3 | 26 | 1653 |
| DYS487 | (AAT)13 | (AAT)14 | 21 | 172 |
| DYS487 | (AAT)14 | (AAT)13 | 28 | 1410 |
| DYS495 | (AAT)15 | (AAT)16 | 26 | 775 |
| DYS495 | (AAT)16 | (AAT)16 | 30 | 1274 |
| DYS496 | (AAT)17 | (AAT)16 | 31 | 1596 |
| DYS497 | (TTA)15 | (TTA)14 | 25 | 58 |
| DYS497 | (TPA)15 | (TTA)16 | 40 | 305 |
| DYS504 | (CCTT)17N7(CCCT)3 | (CCTT)16N7(CCCT)3 | 25 | 275 |
| DYS504 | (CCTT)18N7(CCCT)3 | (CCTT)18N7(CCCT)3 | Unknown | 1223 |
| DYS504 | (CCTT)17N7(CCCT)3 | (CCTT)18N7(CCCT)3 | 39 | 1502 |
| DYS504 | (CCTT)18N7(CCCT)3 | (CCTT)17N7(CCCT)3 | 30 | 1796 |
| DYS504 | (CCTT)18N7(CCCT)3 | (CCTT)17N7(CCCT)3 | 54 | 1895 |
| DYS505 | (TCCT)13 | (TCCT)12 | 64 | 851 |
| DYS505 | (TCCT)12 | (TCCT)13 | 25 | 1070 |
| DYS506 | (TATC)10 | (TATC)11 | 32 | 1369 |
| DYS506 | (TATC)11 | (TATC)12 | 21 | 1635 |
| DYS506 | (TATC)11 | (TATC)10 | 20 | 1862 |
| DYS506 | (TATC)14 | (TATC)13 | 67 | 1954 |
| DYS609 | (AAT)19(AATAA)1(AAAT)3 | (AAT)36(AATAA)1(AAAT)3 | 19 | 680 |

FIGURE 6 [con't]

| Locus | Father Allele | Son Allele | Father's Age | Father Reference # |
|---|---|---|---|---|
| DYS510 | (GATA)3N12(GATA)12N13(GGAT)4N9(GATA)3 | (GATA)3N12(GATA)13N13(GGAT)4N9(GATA)3 | 24 | 17 |
| DYS510 | (GATA)3N12(GATA)12N13(GGAT)4N9(GATA)3 | (GATA)3N12(GATA)11N13(GGAT)4N9(GATA)3 | 34 | 166 |
| DYS510 | (GATA)3N12(GATA)12N13(GGAT)4N8(GATA)3 | (GATA)3N12(GATA)11N13(GGAT)4N9(GATA)3 | 25 | 195 |
| DYS510 | (GATA)3N12(GATA)15N13(GGAT)4N9(GATA)3 | (GATA)3N12(GATA)14N13(GGAT)4N9(GATA)3 | 19 | 761 |
| DYS510 | (GATA)3N12(GATA)11N13(GGAT)4N9(GATA)3 | (GATA)3N12(GATA)10N13(GGAT)4N9(GATA)3 | 19 | 915 |
| DYS510 | (GATA)3N12(GATA)14N13(GGAT)4N9(GATA)3 | (GATA)3N12(GATA)15N13(GGAT)4N9(GATA)3 | 43 | 929 |
| DYS510 | (GATA)3N12(GATA)12N13(GGAT)4N9(GATA)3 | (GATA)3N12(GATA)11N13(GGAT)4N9(GATA)3 | 33 | 1112 |
| DYS510 | (GATA)3N12(GATA)13N13(GGAT)4N9(GATA)3 | (GATA)3N12(GATA)11N13(GGAT)4N9(GATA)3 | 34 | 1118 |
| DYS510 | (GATA)3N12(GATA)14N13(GGAT)4N9(GATA)3 | (GATA)3N12(GATA)15N13(GGAT)4N9(GATA)3 | 45 | 1364 |
| DYS510 | (GATA)3N12(GATA)12N13(GGAT)4N9(GATA)3 | (GATA)3N12(GATA)14N13(GGAT)4N9(GATA)3 | 28 | 1758 |
| DYS511 | (GATA)13 | (GATA)12 | 22 | 418 |
| DYS511 | (GATA)11 | (GATA)12 | 52 | 1804 |
| DYS513 | (TCTA)4(TCCA)11(TATC)3CGTA)1(TCTA)12 | (TCTA)4(TCCA)11(TATC)3CGTA)1(TCTA)13 | 33 | 29 |
| DYS513 | (TCTA)4(TCCA)11(TATC)3CGTA)1(TCTA)14 | (TCTA)4(TCCA)11(TATC)3CGTA)1(TCTA)13 | 23 | 134 |
| DYS513 | (TCTA)4(TCCA)11(TATC)3CGTA)1(TCTA)13 | (TCTA)4(TCCA)11(TATC)3CGTA)1(TCTA)12 | 33 | 187 |
| DYS513 | (TCTA)4(TCCA)11(TATC)3CGTA)1(TCTA)13 | (TCTA)4(TCCA)11(TATC)3CGTA)1(TCTA)14 | 30 | 1161 |
| DYS513 | (TCTA)4(TCCA)11(TATC)3CGTA)1(TCTA)13 | (TCTA)4(TCCA)11(TATC)3CGTA)1(TCTA)14 | 21 | 1216 |
| DYS513 | (TCTA)4(TCCA)11(TATC)3CGTA)1(TCTA)13 | (TCTA)4(TCCA)11(TATC)3CGTA)1(TCTA)14 | Unknown | 1308 |
| DYS513 | (TCTA)4(TCCA)11(TATC)3CGTA)1(TCTA)12 | (TCTA)4(TCCA)11(TATC)3CGTA)1(TCTA)11 | 22 | 1323 |
| DYS513 | (TCTA)4(TCCA)11(TATC)3CGTA)1(TCTA)12 | (TCTA)4(TCCA)11(TATC)3CGTA)1(TCTA)11 | 36 | 1421 |
| DYS513 | (TCTA)4(TCCA)11(TATC)3CGTA)1(TCTA)13 | (TCTA)4(TCCA)11(TATC)3CGTA)1(TCTA)12 | 36 | 1672 |
| DYS513 | (TCTA)4(TCCA)11(TATC)3CGTA)1(TCTA)11 | (TCTA)4(TCCA)11(TATC)3CGTA)1(TCTA)12 | 60 | 1695 |
| DYS516 | (TCT)4N30(TCT)16 | (TCT)4N30(TCT)15 | 28 | 196 |
| DYS516 | (TCT)4N30(TCT)14 | (TCT)4N30(TCT)13 | 37 | 934 |
| DYS516 | (TCT)4N30(TCT)10 | (TCT)4N30(TCT)13 | 44 | 973 |
| DYS516 | (TCT)4N30(TCT)15 | (TCT)4N30(TCT)16 | 34 | 1030 |
| DYS516 | (TCT)4N30(TCT)13 | (TCT)4N30(TCT)14 | Unknown | 1241 |
| DYS516 | (TCT)4N30(TCT)12 | (TCT)4N30(TCT)13 | 35 | 1524 |
| DYS516 | (TCT)4N30(TCT)14 | (TCT)4N30(TCT)15 | 42 | 1626 |
| DYS516 | (TCT)4N30(TCT)14 | (TCT)4N30(TCT)15 | 22 | 1778 |
| DYS516 | (TCT)4N30(TCT)15 | (TCT)4N30(TCT)16 | 24 | 1782 |
| DYS516 | (TCT)4N30(TCT)12 | (TCT)4N30(TCT)11 | 53 | 1669 |
| DYS516 | (TCT)4N30(TCT)17 | (TCT)4N30(TCT)15 | 50 | 1881 |
| DYS517 | (AAAG)15N8(AAAG)3 | (AAAG)15N8(AAAG)3 | 26 | 802 |
| DYS517 | (AAAG)14N8(AAAG)3 | (AAAG)15N8(AAAG)3 | 39 | 1796 |
| DYS517 | (AAAG)16N8(AAAG)3 | (AAAG)15N8(AAAG)3 | 63 | 1807 |
| DYS517 | (AAAG)14N8(AAAG)3 | (AAAG)15N8(AAAG)3 | 54 | 1860 |
| DYS517 | (AAAG)14N8(AAAG)3 | (AAAG)15N8(AAAG)3 | 53 | 1869 |
| DYS518 | (AAAG)3(GAAG)1(AAAG)16(GGAG)1(AAAG)4 N6(AAAG)17N27 (AAGG)4 | (AAAG)3(GAAG)1(AAAG)15(GGAG)1(AAAG)4 N6(AAAG)17N27 (AAGG)4 | 33 | 29 |

FIGURE 6 [con't]

| Locus | Father Allele | Son Allele | Father's Age | Father Reference # |
|---|---|---|---|---|
| DYS518 | (AAAG)3(GAAG)1(AAAG)14(GGAG)1(AAAG)4 N6(AAAG)14N27 (AAGG)4 | (AAAG)3(GAAG)1(AAAG)14(GGAG)1(AAAG)4 N6(AAAG)15N27 (AAGG)4 | 32 | 56 |
| DYS518 | (AAAG)3(GAAG)1(AAAG)17(GGAG)1(AAAG)4 N6(AAAG)12N27 (AAGG)4 | (AAAG)3(GAAG)1(AAAG)16(GGAG)1(AAAG)4 N6(AAAG)12N27 (AAGG)4 | 46 | 74 |
| DYS518 | (AAAG)3(GAAG)1(AAAG)15(GGAG)1(AAAG)4 N6(AAAG)16N27 (AAGG)4 | (AAAG)3(GAAG)1(AAAG)14(GGAG)1(AAAG)4 N6(AAAG)15N27 (AAGG)4 | 30 | 67 |
| DYS518 | (AAAG)3(GAAG)1(AAAG)18(GGAG)1(AAAG)4 N6(AAAG)15N27 (AAGG)4 | (AAAG)3(GAAG)1(AAAG)17(GGAG)1(AAAG)4 N6(AAAG)16N27 (AAGG)4 | 34 | 88 |
| DYS518 | (AAAG)3(GAAG)1(AAAG)17(GGAG)1(AAAG)4 N6(AAAG)13N27 (AAGG)4 | (AAAG)3(GAAG)1(AAAG)16(GGAG)1(AAAG)4 N6(AAAG)10N27 (AAGG)4 | 29 | 89 |
| DYS518 | (AAAG)3(GAAG)1(AAAG)15(GGAG)1(AAAG)4 N6(AAAG)17N27 (AAGG)4 | (AAAG)3(GAAG)1(AAAG)18(GGAG)1(AAAG)4 N6(AAAG)17N27 (AAGG)4 | 50 | 270 |
| DYS518 | (AAAG)3(GAAG)1(AAAG)18(GGAG)1(AAAG)4 N6(AAAG)15N27 (AAGG)4 | (AAAG)3(GAAG)1(AAAG)15(GGAG)1(AAAG)4 N6(AAAG)15N27 (AAGG)4 | 25 | 426 |
| DYS518 | (AAAG)3(GAAG)1(AAAG)22(GGAG)1(AAAG)4 N6(AAAG)13N27 (AAGG)4 | (AAAG)3(GAAG)1(AAAG)21(GGAG)1(AAAG)4 N6(AAAG)13N27 (AAGG)4 | 26 | 433 |
| DYS518 | (AAAG)3(GAAG)1(AAAG)15(GGAG)1(AAAG)4 N6(AAAG)12N27 (AAGG)4 | (AAAG)3(GAAG)1(AAAG)15(GGAG)1(AAAG)4 N6(AAAG)11N27 (AAGG)4 | 28 | 525 |
| DYS518 | (AAAG)3(GAAG)1(AAAG)15(GGAG)1(AAAG)4 N6(AAAG)12N27 (AAGG)4 | (AAAG)3(GAAG)1(AAAG)15(GGAG)1(AAAG)4 N6(AAAG)16N27 (AAGG)4 | 24 | 571 |
| DYS518 | (AAAG)3(GAAG)1(AAAG)18(GGAG)1(AAAG)4 N6(AAAG)14N27 (AAGG)4 | (AAAG)3(GAAG)1(AAAG)17(GGAG)1(AAAG)4 N6(AAAG)14N27 (AAGG)4 | 21 | 593 |
| DYS518 | (AAAG)3(GAAG)1(AAAG)16(GGAG)1(AAAG)4N8(AAAG)N8(AAAG)AG)1N 27(AAGG)4 | (AAAG)3(GAAG)1(AAAG)15(GGAG)1(AAAG)4 N6(AAAG)17N27 (AAGG)4 | 23 | 687 |
| DYS518 | (AAAG)3(GAAG)1(AAAG)16(GGAG)1(AAAG)4 N6(AAAG)14N27 (AAGG)4 | (AAAG)3(GAAG)1(AAAG)16(GGAG)1(AAAG)4 N6(AAAG)15N27 (AAGG)4 | 20 | 703 |
| DYS518 | (AAAG)3(GAAG)1(AAAG)17(GGAG)1(AAAG)4 N6(AAAG)15N27 (AAGG)4 | (AAAG)3(GAAG)1(AAAG)16(GGAG)1(AAAG)4 N6(AAAG)15N27 (AAGG)4 | 20 | 741 |
| DYS518 | (AAAG)3(GAAG)1(AAAG)16(GGAG)1(AAAG)4 N6(AAAG)16N27 (AAGG)4 | (AAAG)3(GAAG)1(AAAG)15(GGAG)1(AAAG)4 N6(AAAG)17N27 (AAGG)4 | 22 | 747 |
| DYS518 | (AAAG)3(GAAG)1(AAAG)15(GGAG)1(AAAG)4 N6(AAAG)16N27 (AAGG)4 | (AAAG)3(GAAG)1(AAAG)16(GGAG)1(AAAG)4 N6(AAAG)18N27 (AAGG)4 | 15 | 783 |
| DYS518 | (AAAG)3(GAAG)1(AAAG)17(GGAG)1(AAAG)4 N6(AAAG)14N27 (AAGG)4 | (AAAG)3(GAAG)1(AAAG)16(GGAG)1(AAAG)4 N6(AAAG)18N27 (AAGG)4 | 22 | 817 |
| DYS518 | (AAAG)3(GAAG)1(AAAG)18(GGAG)1(AAAG)4 N6(AAAG)17N27 (AAGG)4 | (AAAG)3(GAAG)1(AAAG)16(GGAG)1(AAAG)4 N6(AAAG)17N27 (AAGG)4 | 23 | 889 |
| DYS518 | (AAAG)3(GAAG)1(AAAG)15(GGAG)1(AAAG)4 N6(AAAG)16N27 (AAGG)4 | (AAAG)3(GAAG)1(AAAG)14(GGAG)1(AAAG)4 N6(AAAG)16N27 (AAGG)4 | 19 | 915 |
| DYS518 | (AAAG)3(GAAG)1(AAAG)16(GGAG)1(AAAG)4 N6(AAAG)16N27 (AAGG)4 | (AAAG)3(GAAG)1(AAAG)17(GGAG)1(AAAG)4 N6(AAAG)15N27 (AAGG)4 | 56 | 1043 |

FIGURE 6 [con't]

| Locus | Father Allele | Son Allele | Father's Age | Father Reference # |
|---|---|---|---|---|
| DYS518 | (AAAG)3(GAAG)1(AAAG)17(GGAG)1(AAAG)1 N6(AAAG)17N27 (AAGG)4 | (AAAG)3(GAAG)1(AAAG)17(GGAG)1(AAAG)1 N6(AAAG)16N27 (AAGG)4 | 57 | 1107 |
| DYS518 | (AAAG)3(GAAG)1(AAAG)16(GGAG)1(AAAG)4 N6(AAAG)17N27 (AAGG)4 | (AAAG)3(GAAG)1(AAAG)16(GGAG)1(AAAG)4 N6(AAAG)18N27 (AAGG)4 | 19 | 1115 |
| DYS518 | (AAAG)3(GAAG)1(AAAG)17(GGAG)1(AAAG)4 N6(AAAG)17N27 (AAGG)4 | (AAAG)3(GAAG)1(AAAG)17(GGAG)1(AAAG)4 N6(AAAG)18N27 (AAGG)4 | 21 | 1273 |
| DYS518 | (AAAG)3(GAAG)1(AAAG)15(GGAG)1(AAAG)4 N6(AAAG)17N27 (AAGG)4 | (AAAG)3(GAAG)1(AAAG)16(GGAG)1(AAAG)4 N6(AAAG)13N27 (AAGG)4 | 45 | 1364 |
| DYS518 | (AAAG)3(GAAG)1(AAAG)16(GGAG)1(AAAG)4 N6(AAAG)17N27 (AAGG)4 | (AAAG)3(GAAG)1(AAAG)15(GGAG)1(AAAG)4 N6(AAAG)15N27 (AAGG)4 | 42 | 1411 |
| DYS518 | (AAAG)3(GAAG)1(AAAG)16(GGAG)1(AAAG)4 N6(AAAG)18N27 (AAGG)4 | (AAAG)3(GAAG)1(AAAG)16(GGAG)1(AAAG)4 N6(AAAG)19N27 (AAGG)4 | 32 | 1545 |
| DYS518 | (AAAG)3(GAAG)1(AAAG)16(GGAG)1(AAAG)4 N6(AAAG)18N27 (AAGG)4 | (AAAG)3(GAAG)1(AAAG)16(GGAG)1(AAAG)4 N6(AAAG)15N27 (AAGG)4 | 29 | 1790 |
| DYS520 | (GATA)12(CATA)11 | (GATA)11(CATA)11 | 32 | 55 |
| DYS520 | (GATA)12(CATA)11 | (GATA)11(CATA)11 | 34 | 86 |
| DYS520 | (GATA)12(CATA)10 | (GATA)12(CATA)11 | 31 | 141 |
| DYS520 | (GATA)11(CATA)11 | (GATA)12(CATA)11 | 31 | 434 |
| DYS521 | (CTTT)5(TCTT)5(TTT)1(CTTT)51(CTTT)13 | (CTTT)5(TCTT)5(TTT)1(CTTT)51(CTTT)2 | 25 | 133 |
| DYS522 | (ATAG)10 | (ATAG)11 | 22 | 1069 |
| DYS525 | (AGAT)11 | (AGAT)10 | 24 | 571 |
| DYS526a | (CCTT)16 | (CCTT)15 | 64 | 165 |
| DYS526a | (CCTT)13 | (CCTT)14 | 53 | 463 |
| DYS526a | (CCTT)14 | (CCTT)13 | 31 | 1315 |
| DYS526a | (CCTT)11 | (CCTT)12 | 31 | 1652 |
| DYS526b | (CCCT)3N20(CTTT)14(CCTT)9N113(CCTT)11 | (CCCT)3N20(CTTT)13(CCTT)15N113(CCTT)11 | 24 | 17 |
| DYS526b | (CCCT)3N20(CTTT)16(CCTT)9N113(CCTT)14 | (CCCT)3N20(CTTT)15(CCTT)16N113(CCTT)14 | 50 | 42 |
| DYS526b | (CCCT)3N20(CTTT)17(CCTT)9N113(CCTT)14 | (CCCT)3N20(CTTT)16(CCTT)16N113(CCTT)14 | 34 | 86 |
| DYS526b | (CCCT)3N20(CTTT)16(CCTT)9N113(CCTT)12 | (CCCT)3N20(CTTT)15(CCTT)16N113(CCTT)12 | 25 | 185 |
| DYS526b | (CCCT)3N20(CTTT)17(CCTT)9N113(CCTT)14 | (CCCT)3N20(CTTT)16(CCTT)16N113(CCTT)14 | 41 | 293 |
| DYS526b | (CCCT)3N20(CTTT)16(CCTT)11(CCTT)9N113(CCTT)14 | (CCCT)3N20(CTTT)15(CCTT)17N113(CCTT)14 | 41 | 386 |
| DYS526b | (CCCT)3N20(CTTT)16(CCTT)9N113(CCTT)10 | (CCCT)3N20(CTTT)15(CCTT)16N113(CCTT)10 | 31 | 505 |
| DYS526b | (CCCT)3N20(CTTT)17(CCTT)9N113(CCTT)10 | (CCCT)3N20(CTTT)17(CCTT)17N113(CCTT)10 | 32 | 523 |
| DYS526b | (CCCT)3N20(CTTT)16(CCTT)9N113(CCTT)14 | (CCCT)3N20(CTTT)17(CCTT)16N113(CCTT)14 | 39 | 654 |
| DYS526b | (CCCT)3N20(CTTT)16(CCTT)9N113(CCTT)14 | (CCCT)3N20(CTTT)15(CCTT)17N113(CCTT)14 | 25 | 918 |
| DYS526b | (CCCT)3N20(CTTT)15(CCTT)9N113(CCTT)14 | (CCCT)3N20(CTTT)16(CCTT)15N113(CCTT)14 | 36 | 983 |
| DYS526b | (CCCT)3N20(CTTT)14(CCTT)9N113(CCTT)14 | (CCCT)3N20(CTTT)15(CCTT)15N113(CCTT)14 | 37 | 1107 |
| DYS526b | (CCCT)3N20(CTTT)15(CCTT)9N113(CCTT)14 | (CCCT)3N20(CTTT)15(CCTT)15N113(CCTT)14 | 41 | 1122 |
| DYS526b | (CCCT)3N20(CTTT)13(CCTT)9N113(CCTT)14 | (CCCT)3N20(CTTT)14(CCTT)15N113(CCTT)14 | 22 | 1161 |
| DYS526b | (CCCT)3N20(CTTT)13(CCTT)9N113(CCTT)14 | (CCCT)3N20(CTTT)14(CCTT)15N113(CCTT)14 | 45 | 1171 |

FIGURE 6 [con't]

| Locus | Father Allele | Son Allele | Father's Age | Father Reference # |
|---|---|---|---|---|
| DYS626b | (CCCT)3N29(CTTT)16(CCTT)9N13(CCCT)14 | (CCCT)3N29(CTTT)16(CCTT)9N13(CCCT)14 | 49 | 1250 |
| DYS626b | (CCCT)3N29(CTTT)14(CCTT)9N13(CCCT)12 | (CCCT)3N29(CTTT)14(CCTT)9N13(CCCT)12 | 54 | 1447 |
| DYS626b | (CCCT)3N29(CTTT)14(CCTT)9N13(CCCT)13 | (CCCT)3N29(CTTT)14(CCTT)9N13(CCCT)13 | 21 | 1555 |
| DYS626b | (CCCT)3N29(CTTT)14(CCTT)9N13(CCCT)13 | (CCCT)3N29(CTTT)14(CCTT)9N13(CCCT)13 | 29 | 1862 |
| DYS626b | (CCCT)3N29(CTTT)14(CCTT)9N13(CCCT)14 | (CCCT)3N29(CTTT)14(CCTT)9N13(CCCT)14 | 50 | 1881 |
| DYS631 | (AAAT)11 | (AAAT)9 | 22 | 747 |
| DYS632 | 7(TCCC)3N5(TTCC)3N8(TTCC)1(TTCT)12N1 | 7(TCCC)3N5(TTCC)3N8(TTCC)1(TTCT)13N1 | 26 | 759 |
|  | 7(TTCT)3N13(TTCC)4N7(TCT)3N6(TTCT)3 | 7(TTCT)3N13(TTCC)4N7(TCT)3N6(TTCT)3 |  |  |
| DYS632 | 7(TCCC)3N5(TTCC)3N8(TTCC)1(TTCT)12N1 | 7(TCCC)3N5(TTCC)3N8(TTCC)1(TTCT)11N1 | 30 | 1101 |
|  | 7(TTCT)3N13(TTCC)4N7(TCT)3N8(TTCT)3 | 7(TTCT)3N13(TTCC)4N7(TCT)3N8(TTCT)3 |  |  |
| DYS632 | 7(TCCC)3N5(TTCC)3N8(TTCC)1(TTCT)12N1 | 7(TCCC)3N5(TTCC)3N8(TTCC)1(TTCT)13N1 | 29 | 1266 |
|  | 7(TTCT)3N13(TTCC)4N7(TCT)3N8(TTCT)3 | 7(TTCT)3N13(TTCC)4N7(TCT)3N8(TTCT)3 |  |  |
| DYS632 | 7(TCCC)3N5(TTCC)3N8(TTCC)1(TTCT)12N1 | 7(TCCC)3N5(TTCC)3N8(TTCC)1(TTCT)13N1 | 30 | 1347 |
|  | 7(TTCT)3N13(TTCC)4N7(TCT)3N8(TTCT)3 | 7(TTCT)3N13(TTCC)4N7(TCT)3N8(TTCT)3 |  |  |
| DYS533 | (TATC)13 | (TATC)12 | 34 | 27 |
| DYS533 | (TATC)13 | (TATC)12 | 29 | 892 |
| DYS533 | (TATC)13 | (TATC)12 | 37 | 905 |
| DYS533 | (TATC)13 | (TATC)14 | 16 | 1039 |
| DYS533 | (TATC)12 | (TATC)13 | 42 | 1054 |
| DYS533 | (TATC)14 | (TATC)15 | 34 | 1158 |
| DYS533 | (TATC)12 | (TATC)13 | 21 | 1166 |
| DYS533 | (TATC)13 | (TATC)12 | 40 | 1281 |
| DYS534 | (CTTT)3N8(CTTT)16N9(CTTT)3 | (CTTT)3N8(CTTT)17N9(CTTT)3 | 37 | 135 |
| DYS534 | (CTTT)3N8(CTTT)15N9(CTTT)3 | (CTTT)3N8(CTTT)17N9(CTTT)3 | 27 | 167 |
| DYS534 | (CTTT)3N8(CTTT)15N9(CTTT)3 | (CTTT)3N8(CTTT)16N9(CTTT)3 | 17 | 235 |
| DYS534 | (CTTT)3N8(CTTT)14N9(CTTT)3 | (CTTT)3N8(CTTT)15N9(CTTT)3 | 41 | 269 |
| DYS534 | (CTTT)3N8(CTTT)14N9(CTTT)3 | (CTTT)3N8(CTTT)15N9(CTTT)3 | 34 | 358 |
| DYS534 | (CTTT)3N8(CTTT)17N9(CTTT)3 | (CTTT)3N8(CTTT)16N9(CTTT)3 | 39 | 419 |
| DYS534 | (CTTT)3N8(CTTT)13N9(CTTT)3 | (CTTT)3N8(CTTT)14N9(CTTT)3 | 28 | 674 |
| DYS534 | (CTTT)3N8(CTTT)15N9(CTTT)3 | (CTTT)3N8(CTTT)14N9(CTTT)3 | 33 | 1205 |
| DYS534 | (CTTT)3N8(CTTT)14N9(CTTT)3 | (CTTT)3N8(CTTT)17N9(CTTT)3 | 45 | 1364 |
| DYS534 | (CTTT)3N8(CTTT)14N9(CTTT)3 | (CTTT)3N8(CTTT)13N9(CTTT)3 | 58 | 1808 |
| DYS534 | (CTTT)3N8(CTTT)15N9(CTTT)3 | (CTTT)3N8(CTTT)18N9(CTTT)3 | 61 | 1836 |
| DYS536 | (TCCT)12N8(TTCT)14 | (TCCT)13N8(TTCT)14 | 20 | 1093 |
| DYS537 | (TCTA)12 | (TCTA)13 | 29 | 699 |
| DYS537 | (TCTA)13 | (TCTA)12 | 27 | 1248 |
| DYS537 | (TCTA)11 | (TCTA)12 | 40 | 1427 |
| DYS539 | (TAGA)11 | (TAGA)10 | 63 | 1902 |
| DYS540 | (TTAT)12 | (TTAT)13 | 31 | 141 |
| DYS540 | (TTAT)12 | (TTAT)11 | 58 | 152 |

FIGURE 6 [con't]

| Locus | Father Allele | Son Allele | Father's Age | Father Reference # |
|---|---|---|---|---|
| DYS540 | (TAT)11 | (TAT)10 | 19 | 682 |
| DYS540 | (TAT)11 | (TAT)12 | 38 | 4020 |
| DYS540 | (TAT)12 | (TAT)11 | 31 | 1134 |
| DYS541 | (TATC)12(TTC)1(TATC)3 | (TATC)3(TTC)1(TATC)3 | 34 | 151 |
| DYS541 | (TATC)12(TTC)1(TATC)3 | (TATC)11(TTC)1(TATC)3 | 34 | 229 |
| DYS541 | (TATC)14(TTC)1(TATC)3 | (TATC)3(TTC)1(TATC)3 | 33 | 339 |
| DYS541 | (TATC)15(TTC)1(TATC)3 | (TATC)12(TTC)1(TATC)3 | 36 | 733 |
| DYS541 | (TATC)14(TTC)1(TATC)3 | (TATC)13(TTC)1(TATC)3 | 25 | 1416 |
| DYS541 | (TATC)12(TTC)1(TATC)3 | (TATC)13(TTC)1(TATC)3 | 64 | 1843 |
| DYS543 | AGAT)3(GATA)11N42(ATGT)4(ATGG)N35(GAAA)3 | AGAT)3(GATA)16N42(ATGT)4(ATGG)2N35(GAAA)3 | 23 | 16 |
| DYS543 | AGAT)2(GATA)15N42(ATGT)3(ATGG)3N35(GAAA)3 | AGAT)3(GATA)14N42(ATGT)3N35(GAAA)3 | 40 | 74 |
| DYS543 | AGAT)3(GATA)15N42(ATGT)3(ATGG)3N35(GAAA)3 | AGAT)3(GATA)14N42(ATGT)3N35(GAAA)3 | 33 | 644 |
| DYS543 | AGAT)3(GATA)12N42(ATGT)4(ATGG)2N35(GAAA)3 | AGAT)3(GATA)11N42(ATGT)4(ATGG)N35(GAAA)3 | 43 | 939 |
| DYS543 | AGAT)3(GATA)13N42(ATGT)4(ATGG)3N35(GAAA)3 | AGAT)3(GATA)12N42(ATGT)4(ATGG)N35(GAAA)3 | 42 | 1064 |
| DYS543 | AGAT)3(GATA)15N42(ATGT)3(ATGG)3N35(GAAA)3 | AGAT)3(GATA)16N42(ATGT)3N35(GAAA)3 | Unknown | 1083 |
| DYS543 | AGAT)3(GATA)13N42(ATGT)3(ATGG)2N35(GAAA)3 | AGAT)3(GATA)12N42(ATGT)3N35(GAAA)3 | Unknown | 1223 |
| DYS543 | AGAT)3(GATA)15N42(ATGT)3(ATGG)3N35(GAAA)3 | AGAT)3(GATA)14N42(ATGT)3N35(GAAA)3 | 31 | 1229 |
| DYS543 | AGAT)3(GATA)13N42(ATGT)3(ATGG)3N35(GAAA)3 | AGAT)3(GATA)12N42(ATGT)3N35(GAAA)3 | 31 | 1315 |
| DYS543 | AGAT)3(GATA)11N42(ATGT)4(ATGG)2N35(GAAA)3 | AGAT)3(GATA)12N42(ATGT)4(ATGG)N35(GAAA)3 | Unknown | 1581 |
| DYS543 | AGAT)3(GATA)13N42(ATGT)3(ATGG)2N35(GAAA)3 | AGAT)3(GATA)14N42(ATGT)3N35(GAAA)3 | 28 | 1712 |
| DYS545 | (TTC)3N23(TCT)3N33(TCC)3N16(TCT)17 | (TTC)3N23(TCT)3N33(TCC)3N16(TCT)18 | 34 | 371 |
| DYS545 | (TCC)3N23(TTC)3N33(TCC)3N16(TTC)16 | (TCC)3N23(TCT)3N33(TCC)3N16(TTC)15 | 20 | 708 |
| DYS545 | (TCC)3N23(TTC)3N33(TCC)3N16(TTC)16 | (TCC)3N23(TTC)3N33(TCC)3N16(TTC)17 | 20 | 756 |
| DYS545 | (TCC)3N23(TTC)3N33(TCC)3N16(TTC)17 | (TCC)3N23(TTC)3N33(TCC)3N16(TTC)16 | 31 | 878 |
| DYS545 | (TCC)3N23(TTC)3N33(TCC)3N16(TTC)18 | (TCC)3N23(TTC)3N33(TCC)3N16(TTC)17 | 23 | 1119 |
| DYS545 | (TCC)3N23(TTC)3N33(TCC)3N16(TTC)15 | (TCC)3N23(TTC)3N33(TCC)3N16(TTC)14 | 55 | 1840 |
| DYS546 | (CCTT)10T(CTTC)5N56(TTTC)17N10(CCTT)4 | (CCTT)10T(CTTC)5N56(TTTC)17N10(CCTT)4 | 28 | 1 |
| DYS546 | (CCTT)12T(CTTC)4N56(TTTC)15N10(CCTT)4 | (CCTT)12T(CTTC)4N56(TTTC)15N10(CCTT)4 | 46 | 10 |
| DYS546 | (CCTT)11T(CTTC)5N56(TTTC)17N10(CCTT)4 | (CCTT)11T(CTTC)5N56(TTTC)18N10(CCTT)4 | 59 | 152 |
| DYS546 | (CCTT)13T(CTTC)5N56(TTTC)14N10(CCTT)3 | (CCTT)12T(CTTC)5N56(TTTC)14N10(CCTT)3 | 34 | 243 |
| DYS547 | (CCTT)13T(CTTC)5N56(TTTC)14N10(CCTT)4 | (CCTT)13T(CTTC)5N56(TTTC)13N14(TTTC)3 | 31 | 268 |
| DYS547 | (CCTT)12T(CTTC)5N56(TTTC)12N14(TTTC)3 | (CCTT)12T(CTTC)5N56(TTTC)11N14(TTTC)3 | 50 | 278 |
| DYS547 | (TCTC)10T(CTTC)5N56(TTTC)10N14(TTTC)3 | (TCTC)10T(CTTC)5N56(TTTC)10N14(TTTC)3 | 33 | 339 |

FIGURE 6 [con't]

| Locus | Father Allele | Son Allele | Father's Age | Father Reference # |
|---|---|---|---|---|
| DYS647 | (CCTT)12T(CTTC)4N56(TTTC)17N10(CCTT)4(TCTC)1(TTTC)11N14(TTTC)3 | (CCTT)12T(CTTC)5N56(TTTC)17N10(CCTT)4(TCTC)1(TTTC)10N14(TTTC)3 | 36 | 378 |
| DYS647 | (CCTT)13T(CTTC)4N56(TTTC)16N10(CCTT)4(TCTC)1(TTTC)12N14(TTTC)3 | (CCTT)12T(CTTC)4N56(TTTC)17N10(CCTT)4(TCTC)1(TTTC)13N14(TTTC)3 | 28 | 425 |
| DYS647 | (CCTT)12T(CTTC)5N56(TTTC)18N10(CCTT)4(TCTC)1(TTTC)11N14(TTTC)3 | (CCTT)13T(CTTC)4N56(TTTC)18N10(CCTT)4(TCTC)1(TTTC)12N14(TTTC)3 | 20 | 484 |
| DYS647 | (CCTT)12T(CTTC)4N56(TTTC)17N10(CCTT)4(TCTC)1(TTTC)12N14(TTTC)3 | (CCTT)12T(CTTC)5N56(TTTC)16N10(CCTT)4(TCTC)1(TTTC)11N14(TTTC)3 | 31 | 613 |
| DYS647 | (CCTT)12T(CTTC)4N56(TTTC)16N10(CCTT)4(TCTC)1(TTTC)12N14(TTTC)3 | (CCTT)12T(CTTC)4N56(TTTC)16N10(CCTT)4(TCTC)1(TTTC)11N14(TTTC)3 | 39 | 654 |
| DYS647 | (CCTT)12T(CTTC)4N56(TTTC)15N10(CCTT)4(TCTC)1(TTTC)12N14(TTTC)3 | (CCTT)12T(CTTC)4N56(TTTC)14N10(CCTT)4(TCTC)1(TTTC)12N14(TTTC)3 | 27 | 710 |
| DYS647 | (CCTT)12T(CTTC)5N56(TTTC)16N10(CCTT)4(TCTC)1(TTTC)11N14(TTTC)3 | (CCTT)13T(CTTC)4N56(TTTC)14N10(CCTT)4(TCTC)1(TTTC)11N14(TTTC)3 | 26 | 711 |
| DYS647 | (CCTT)10T(CTTC)4N56(TTTC)16N10(CCTT)3(TCTC)1(TTTC)12N14(TTTC)3 | (CCTT)13T(CTTC)5N56(TTTC)17N10(CCTT)4(TCTC)1(TTTC)10N14(TTTC)3 | 59 | 846 |
| DYS647 | (CCTT)12T(CTTC)4N56(TTTC)16N10(CCTT)3(TCTC)1(TTTC)12N14(TTTC)3 | (CCTT)12T(CTTC)4N56(TTTC)17N10(CCTT)4(TCTC)1(TTTC)12N14(TTTC)3 | 57 | 894 |
| DYS647 | (CCTT)12T(CTTC)4N56(TTTC)8N10(CCTT)3(TCTC)1(TTTC)13N14(TTTC)3 | (CCTT)12T(CTTC)4N54(TTTC)18N10(CCTT)4(TCTC)1(TTTC)13N14(TTTC)3 | 22 | 986 |
| DYS647 | (CCTT)12T(CTTC)5N56(TTTC)22N10(CCTT)4(TCTC)1(TTTC)9N14(TTTC)3 | (CCTT)12T(CTTC)5N56(TTTC)24N10(CCTT)4(TCTC)1(TTTC)14N14(TTTC)3 | 65 | 1022 |
| DYS647 | (CCTT)12T(CTTC)4N56(TTTC)16N10(CCTT)3(TCTC)1(TTTC)13N14(TTTC)3 | (CCTT)12T(CTTC)4N56(TTTC)16N10(CCTT)4(TCTC)1(TTTC)14N14(TTTC)3 | 43 | 1153 |
| DYS647 | (CCTT)12T(CTTC)4N56(TTTC)19N10(CCTT)3(TCTC)1(TTTC)12N14(TTTC)3 | (CCTT)12T(CTTC)4N56(TTTC)18N10(CCTT)4(TCTC)1(TTTC)12N14(TTTC)3 | 31 | 1229 |
| DYS647 | (CCTT)12T(CTTC)4N56(TTTC)16N10(CCTT)3(TCTC)1(TTTC)13N14(TTTC)3 | (CCTT)12T(CTTC)4N56(TTTC)16N10(CCTT)4(TCTC)1(TTTC)12N14(TTTC)3 | 29 | 1276 |
| DYS647 | (CCTT)12T(CTTC)4N56(TTTC)16N10(CCTT)3(TCTC)1(TTTC)12N14(TTTC)3 | (CCTT)12T(CTTC)4N56(TTTC)19N10(CCTT)4(TCTC)1(TTTC)12N14(TTTC)3 | 28 | 1294 |
| DYS647 | (CCTT)11T(CTTC)4N56(TTTC)18N10(CCTT)3(TCTC)1(TTTC)12N14(TTTC)3 | (CCTT)11T(CTTC)4N56(TTTC)18N10(CCTT)4(TCTC)1(TTTC)13N14(TTTC)3 | 50 | 1297 |
| DYS647 | (CCTT)11T(CTTC)4N56(TTTC)15N10(CCTT)3(TCTC)1(TTTC)11N14(TTTC)3 | (CCTT)12T(CTTC)4N56(TTTC)15N10(CCTT)4(TCTC)1(TTTC)14N14(TTTC)3 | 32 | 1321 |
| DYS647 | (CCTT)12T(CTTC)4N56(TTTC)15N10(CCTT)3(TCTC)1(TTTC)12N14(TTTC)3 | (CCTT)10T(CTTC)4N56(TTTC)16N10(CCTT)4(TCTC)1(TTTC)16N14(TTTC)3 | 41 | 1379 |
| DYS647 | (CCTT)10T(CTTC)5N56(TTTC)19N10(CCTT)3(TCTC)1(TTTC)10N14(TTTC)3 | (CCTT)13T(CTTC)5N54(TTTC)18N10(CCTT)4(TCTC)1(TTTC)9N14(TTTC)3 | 24 | 1466 |
| DYS647 | (CCTT)12T(CTTC)5N56(TTTC)18N10(CCTT)3(TCTC)1(TTTC)12N14(TTTC)3 | (CCTT)12T(CTTC)4N56(TTTC)18N10(CCTT)4(TCTC)1(TTTC)12N14(TTTC)3 | 42 | 1485 |
| DYS647 | (CCTT)12T(CTTC)5N56(TTTC)15N10(CCTT)3 | (CCTT)12T(CTTC)5N56(TTTC)16N10(CCTT)4 | 29 | 1491 |

FIGURE 6 [con't]

| Locus | Father Allele | Son Allele | Father's Age | Father Reference # |
|---|---|---|---|---|
| DYS547 | (TCTC)1(TTC)13N14(TTC)3 | (TCTC)1(TTC)13N14(TTC)3 | 23 | 1510 |
| DYS547 | (CCTT)12T(CTTC)4N56(TTTC)16N10(CCTT)4(TCTC)1(TTTC)12N14(TTTC)3 | (CCTT)12T(CTTC)4N56(TTTC)17N10(CCTT)4(TCTC)1(TTTC)12N14(TTTC)3 | 38 | 1524 |
| DYS547 | (CCTT)12T(CTTC)5N56(TTTC)16N10(CCTT)4(TCTC)1(TTTC)11N14(TTTC)3 | (CCTT)12T(CTTC)5N56(TTTC)16N10(CCTT)4(TCTC)1(TTTC)16N14(TTTC)3 | 36 | 1582 |
| DYS547 | (CCTT)12T(CTTC)5N56(TTTC)10N10(CCTT)4(TCTC)1(TTTC)17N14(TTTC)3 | (CCTT)12T(CTTC)5N56(TTTC)10N10(CCTT)4(TCTC)1(TTTC)17N14(TTTC)3 | 28 | 1640 |
| DYS547 | (CCTT)12T(CTTC)5N56(TTTC)16N10(CCTT)4(TCTC)1(TTTC)13N14(TTTC)3 | (CCTT)12T(CTTC)4N56(TTTC)14N10(CCTT)4(TCTC)1(TTTC)12N14(TTTC)3 | 22 | 1648 |
| DYS547 | (CCTT)12T(CTTC)5N56(TTTC)16N10(CCTT)4(TCTC)1(TTTC)12N14(TTTC)3 | (CCTT)12T(CTTC)5N56(TTTC)17N10(CCTT)4(TCTC)1(TTTC)12N14(TTTC)3 | 57 | 1663 |
| DYS547 | (CCTT)12T(CTTC)4N56(TTTC)16N10(CCTT)4(TCTC)1(TTTC)12N14(TTTC)3 | (CCTT)12T(CTTC)4N56(TTTC)17N10(CCTT)4(TCTC)1(TTTC)12N14(TTTC)3 | Unknown | 1725 |
| DYS547 | (CCTT)12T(CTTC)5N56(TTTC)14N10(CCTT)4(TCTC)1(TTTC)12N14(TTTC)3 | (CCTT)12T(CTTC)5N56(TTTC)16N10(CCTT)4(TCTC)1(TTTC)12N14(TTTC)3 | 54 | 1860 |
| DYS547 | (CCTT)16T(CTTC)5N56(TTTC)16N10(CCTT)4(TCTC)1(TTTC)12N14(TTTC)3 | (CCTT)16T(CTTC)5N56(TTTC)16N10(CCTT)4(TCTC)1(TTTC)12N14(TTTC)3 | 53 | 1871 |
| DYS547 | (CCTT)12T(CTTC)5N56(TTTC)16N10(CCTT)4(TCTC)1(TTTC)11N14(TTTC)3 | (CCTT)12T(CTTC)5N56(TTTC)15N10(CCTT)4(TCTC)1(TTTC)11N14(TTTC)3 | 55 | 1910 |
| DYS547 | (CCTT)12T(CTTC)5N56(TTTC)14N10(CCTT)4(TCTC)1(TTTC)11N14(TTTC)3 | (CCTT)12T(CTTC)5N56(TTTC)14N10(CCTT)4(TCTC)1(TTTC)14N14(TTTC)3 | 65 | 1920 |
| DYS548 | (GATA)13 | (GATA)12 | 30 | 97 |
| DYS549 | (GATA)13 | (GATA)12 | 47 | 113 |
| DYS549 | (GATA)12 | (GATA)11 | 27 | 119 |
| DYS649 | (GATA)12 | (GATA)13 | 38 | 336 |
| DYS649 | (GATA)14 | (GATA)13 | 43 | 472 |
| DYS649 | (GATA)12 | (GATA)11 | 25 | 517 |
| DYS649 | (GATA)12 | (GATA)11 | 22 | 625 |
| DYS651 | (AGAT)15N8(AGAC)3(AGGT)1(AGAT)4 | (AGAT)14N8(AGAC)3(AGGT)1(AGAT)4 | 21 | 436 |
| DYS651 | (AGAT)14N8(AGAC)3(AGGT)1(AGAT)4 | (AGAT)13N8(AGAC)3(AGGT)1(AGAT)4 | 22 | 664 |
| DYS651 | (AGAT)15N8(AGAC)3(AGGT)1(AGAT)4 | (AGAT)14N8(AGAC)3(AGGT)1(AGAT)4 | 41 | 862 |
| DYS651 | (AGAT)14N8(AGAC)3(AGGT)1(AGAT)4 | (AGAT)13N8(AGAC)3(AGGT)1(AGAT)4 | 51 | 1212 |
| DYS651 | (AGAT)13N8(AGAC)3(AGGT)1(AGAT)4 | (AGAT)14N8(AGAC)3(AGGT)1(AGAT)4 | 27 | 1671 |
| DYS652 | (TCTA)3(TCTG)1(TCTA)9N40(TCTA)15 | (TCTA)3(TCTG)1(TCTA)Y N40(TCTA)15 | 25 | 471 |
| DYS652 | (TCTA)3(TCTG)1(TCTA)10N40(TCTA)15 | (TCTA)3(TCTG)1(TCTA)10N40(TCTA)16 | 59 | 845 |
| DYS652 | (TCTA)3(TCTG)1(TCTA)10N40(TGTA)14 | (TCTA)3(TCTG)1(TCTA)10N40(TGTA)15 | 19 | 847 |
| DYS652 | (TCTA)3(TCTG)1(TCTA)11N40(TCTA)14 | (TCTA)3(TCTG)1(TCTA)12N40(TCTA)14 | 31 | 1486 |
| DYS654 | (TAAA)10 | (TAAA)11 | 37 | 1277 |

FIGURE 6 [con't]

| Locus | Father Allele | Son Allele | Father's Age | Father Reference # |
|---|---|---|---|---|
| DYS556 | (AAAT)12 | (AAAT)11 | 30 | 1101 |
| DYS556 | (AAAT)11 | (AAAT)12 | 21 | 1446 |
| DYS557 | (TTTC)4(TTCC)4(TTTC)3(TTTC)16 | (TTTC)4(TTCC)4(TTTC)3(TTTC)18 | 24 | 17 |
| DYS557 | (TTTC)4(TTCC)4(TTTC)3(TTTC)16 | (TTTC)4(TTCC)4(TTTC)3(TTTC)15 | 23 | 52 |
| DYS557 | (TTTC)4(TTCC)4(TTTC)3(TTTC)15 | (TTTC)4(TTCC)4(TTTC)3(TTTC)16 | 34 | 394 |
| DYS557 | (TTTC)4(TTCC)4(TTTC)3(TTTC)15 | (TTTC)4(TTCC)4(TTTC)3(TTTC)16 | 36 | 589 |
| DYS557 | (TTTC)4(TTCC)4(TTTC)3(TTTC)17 | (TTTC)4(TTCC)4(TTTC)3(TTTC)16 | 38 | 1494 |
| DYS557 | (TTTC)4(TTCC)4(TTTC)3(TTTC)15 | (TTTC)4(TTCC)4(TTTC)3(TTTC)16 | 17 | 1517 |
| DYS559 | (TAAA)9 | (TAAA)8 | 27 | 1357 |
| DYS561 | (GATA)13(GACA)4 | (GATA)12(GACA)4 | 34 | 359 |
| DYS565 | (ATAA)13 | (ATAA)12 | 34 | 101 |
| DYS565 | (ATAA)13 | (ATAA)12 | 45 | 924 |
| DYS565 | (ATAA)13 | (ATAA)14 | 27 | 1673 |
| DYS568 | (AAAT)12 | (AAAT)13 | 35 | 1647 |
| DYS569 | (ATT)12 | (ATT)11 | 31 | 598 |
| DYS569 | (ATT)12 | (ATT)11 | 21 | 1053 |
| DYS570 | (TTTC)17 | (TTTC)16 | 34 | 32 |
| DYS570 | (TTTC)19 | (TTTC)20 | 39 | 112 |
| DYS570 | (ATAA)13 | (TTTC)18 | 20 | 240 |
| DYS570 | (TTTC)20 | (TTTC)19 | 37 | 283 |
| DYS570 | (TTTC)17 | (TTTC)18 | 41 | 313 |
| DYS570 | (TTTC)19 | (TTTC)17 | 16 | 316 |
| DYS570 | (TTTC)19 | (TTTC)18 | 25 | 317 |
| DYS570 | (TTTC)20 | (TTTC)20 | 32 | 814 |
| DYS570 | (TTTC)20 | (TTTC)21 | 24 | 855 |
| DYS570 | (TTTC)20 | (TTTC)19 | 30 | 857 |
| DYS570 | (TTTC)21 | (TTTC)22 | 22 | 922 |
| DYS570 | (TTTC)18 | (TTTC)19 | 36 | 1061 |
| DYS570 | (TTTC)19 | (TTTC)20 | 28 | 1253 |
| DYS570 | (TTTC)18 | (TTTC)15 | 41 | 1366 |
| DYS570 | (TTTC)21 | (TTTC)20 | 45 | 1364 |
| DYS570 | (TTTC)17 | (TTTC)18 | 54 | 1895 |
| DYS570 | (TTTC)19 | (TTTC)18 | 66 | 1901 |
| DYS572 | (AAAT)11 | (AAAT)10 | 35 | 735 |
| DYS572 | (AAAT)11 | (AAAT)10 | 24 | 1342 |
| DYS574 | (TTAT)10 | (TTAT)9 | 23 | 1698 |
| DYS576 | (AAAG)17 | (AAAG)18 | 43 | 1818 |
| DYS576 | (AAAG)19 | (AAAG)18 | 28 | 153 |
| DYS576 | (AAAG)17 | (AAAG)18 | 34 | 236 |
| | | | 34 | 243 |

FIGURE 6 [con't]

| Locus | Father Allele | Son Allele | Father's Age | Father Reference # |
|---|---|---|---|---|
| DYS576 | (AAAG)18 | (AAAG)17 | 47 | 347 |
| DYS576 | (AAAG)19 | (AAAG)18 | 17 | 635 |
| DYS576 | (AAAG)19 | (AAAG)18 | 37 | 715 |
| DYS576 | (AAAG)20 | (AAAG)21 | 23 | 715 |
| DYS576 | (AAAG)18 | (AAAG)17 | 38 | 719 |
| DYS576 | (AAAG)20 | (AAAG)21 | 29 | 789 |
| DYS576 | (AAAG)20 | (AAAG)19 | 50 | 884 |
| DYS576 | (AAAG)17 | (AAAG)18 | 42 | 1054 |
| DYS576 | (AAAG)19 | (AAAG)18 | 58 | 1061 |
| DYS576 | (AAAG)18 | (AAAG)19 | Unknown | 1200 |
| DYS576 | (AAAG)18 | (AAAG)19 | 40 | 1204 |
| DYS576 | (AAAG)18 | (AAAG)19 | 51 | 1212 |
| DYS576 | (AAAG)18 | (AAAG)17 | Unknown | 1224 |
| DYS576 | (AAAG)18 | (AAAG)19 | Unknown | 1265 |
| DYS576 | (AAAG)18 | (AAAG)19 | 38 | 1276 |
| DYS576 | (AAAG)17 | (AAAG)16 | 22 | 1403 |
| DYS576 | (AAAG)18 | (AAAG)17 | 42 | 1411 |
| DYS576 | (AAAG)18 | (AAAG)17 | 26 | 1440 |
| DYS576 | (AAAG)18 | (AAAG)19 | 47 | 1675 |
| DYS576 | (AAAG)18 | (AAAG)19 | 55 | 1844 |
| DYS576 | (AAAG)20 | (AAAG)19 | 54 | 1939 |
| DYS578 | (AAAT)8 | (AAAT)9 | Unknown | 1353 |
| DYS585 | (TTATG)9 | (TTATG)10 | 35 | 784 |
| DYS585 | (TTATG)9 | (TTATG)9 | 26 | 1105 |
| DYS585 | (TTATG)9 | (TTATG)10 | 17 | 1109 |
| DYS587 | (CAATA)11(CAGTA)1(CAATA)13 | (CAATA)10(CAGTA)1(CAATA)13 | 24 | 83 |
| DYS587 | (CAATA)11(CAGTA)1(CAATA)13 | (CAATA)12(CAGTA)1(CAATA)13 | 59 | 152 |
| DYS587 | (CAATA)12(CAGTA)1(CAATA)13 | (CAATA)11(CAGTA)1(CAATA)13 | 25 | 260 |
| DYS587 | (CAATA)12(CAGTA)1(CAATA)13 | (CAATA)13(CAGTA)1(CAATA)13 | 63 | 917 |
| DYS590 | (AAAAC)4(AAAAT)8 | (AAAAC)4(AAAAT)7 | 26 | 1062 |
| DYS593 | (AAAAC)4(AAAAT)6 | (AAAAC)4(AAAAT)9 | Unknown | 1353 |
| DYS594 | (AAATA)10 | (AAATA)11 | 31 | 1134 |
| DYS611 | [(TTC)5N9(TTC)4(CT)1(TTC)3(CTC)1(TTC)3N8(TTC)4(CTC)1(TTC)5(CTC)1(TTC)3T(TTC)3N20(TTC)3T(TTC)4 N7 (TTC)3N9(TTC)4(CC)1(TTC)18N23(TTC)3N4 [(TTC)1(CTC)1]2(CTC)1(TTC)13 | [(TTC)5N9(TTC)4(CT)1(TTC)3(CTC)1(TTC)3N8(TTC)4(CTC)1(TTC)5(CTC)1(TTC)3N9(TTC)3N20(TTC)3T(TTC)4 | 30 | 99 |
| DYS611 | [(TTC)5N9(TTC)4(CT)1(TTC)3(CTC)1(TTC)3N8(TTC)4(CTC)1(TTC)5(CTC)1(TTC)3T(TTC)3N20(TTC)3T(TTC)4 | [(TTC)5N9(TTC)4(CT)1(TTC)3(CTC)1(TTC)3N9(TTC)4(CTC)1(TTC)5(CTC)1(TTC)3N20(TTC)3T(TTC)4 | 31 | 164 |

FIGURE 6 [con't]

| Locus | Father Allele | Son Allele | Father's Age | Father Reference # |
|---|---|---|---|---|
| DYS611 | N7 (TTC)3N8(TTC)4(TCC)1TN23(TTC)4N4 (TTC)1(CTC)12(CTC)1(TTC)13 | N7 (TTC)3N8(TTC)4(TCC)1(TTC)16N23(TTC)4N4 (TTC)1(CTC)12(CTC)1(TTC)13 | 20 | 254 |
| | N7 (TTC)5N8(TTC)4(CT)1 (TTC)3N8(TTC)4(CCC)1(TTC)18N23(TTC)4N4 (TTC)1(CTC)12(CTC)1(TTC)13 | | | |
| DYS611 | N7 (TTC)5N8(TTC)4(CT)1 (TTC)3N8(TTC)4(TCC)1(TTC)18N23(TTC)4N4 (TTC)1(CTC)12(CTC)1(TTC)13 | N7 (TTC)3N8(TTC)4(CT)1(TTC)3N8(TTC)4(TCC)1(TTC)16N23(TTC)4N4 (TTC)1(CTC)12(CTC)1(TTC)13 )3N15 | 25 | 517 |
| DYS611 | (TTC)5N8(TTC)4(CT)1(TTC)3N8(CTC)1(TTC)3A28(TTC)9T(TTC)15N23(TTC)4N4 N7 (TTC)1(CTC)12(CTC)1(TTC)13 | N7 (TTC)3N8(TTC)4(CT)1(TTC)3A28(TTC)9T(TTC)14N23(TTC)4N4 (TTC)1(CTC)12(CTC)1(TTC)13 )3N15 | 18 | 946 |
| DYS611 | (TTC)5N8(TTC)4(CT)1(TTC)3N8(CTC)1(TTC)3A28(TTC)9T(TTC)17N23(TTC)4N4 N7 (TTC)1(CTC)12(CTC)1(TTC)13 | N7 (TTC)3N8(TTC)4(CT)1(TTC)3A28(TTC)9(CTC)1(TTC)13 )3N15 | 48 | 969 |
| DYS611 | (TTC)5N8(TTC)4(CT)1(TTC)3N8(CTC)1(TTC)3A28(TTC)9T(TTC)16N23(TTC)4N4 N7 (TTC)1(CTC)12(CTC)1(TTC)13 | N7 (TTC)3N8(TTC)4(CT)1(TTC)3A28(TTC)9T(TTC)15N23(TTC)4N4 (TTC)1(CTC)12(CTC)1(TTC)13 )3N15 | 34 | 990 |
| DYS611 | (TTC)5N8(TTC)4(CT)1(TTC)3N8(CTC)1(TTC)3T(TTC)4 N7 (TTC)16N23(TTC)4N4(TTC)1(CTC)12(CTC)1(TTC)13 | N7 (TTC)3N8(TTC)4(CT)1(TTC)3N8(TTC)4(TCC)1(TTC)15N23(TTC)4N4 (TTC)1(CTC)12(CTC)1(TTC)13 )3N15 | 45 | 1171 |
| DYS611 | (TTC)5N8(TTC)4(CT)1(TTC)3N8(CTC)1(TTC)3T(TTC)4 N7 (TTC)16N23(TTC)4N4(TTC)1(CTC)12(CTC)1(TTC)13 | N7 (TTC)3N8(TTC)4(CT)1(TTC)3A28(TTC)9T(TTC)14N23(TTC)4N4 (TTC)1(CTC)12(CTC)1(TTC)13 )3N15 | 21 | 1216 |
| DYS611 | (TTC)5N8(TTC)4(CT)1(TTC)3N8(CTC)1(TTC)3T(TTC)4 N7 (TTC)17N23(TTC)4N4(TTC)1(CTC)12(CTC)1(TTC)13 | N7 (TTC)3N8(TTC)4(CT)1(TTC)3N8(TTC)4(TCC)1(TTC)16N23(TTC)4N4 (TTC)1(CTC)12(CTC)1(TTC)13 )3N15 | 40 | 1281 |

FIGURE 6 [con't]

| Locus | Father Allele | Son Allele | Father's Age | Father Reference # |
|---|---|---|---|---|
| DYS611 | (TTC)5N8(TTC)4(CTC)1(TTC)3N8(TTC)4(CTC)1(TTC)3N3(TTC)5(CTC)1(TTC)3N15 | (TTC)5N8(TTC)4(CTC)1(TTC)3N8(TTC)4(CTC)1(TTC)3N3(TTC)5(CTC)1(TTC)3N15 | 30 | 1401 |
| | TTC)4(CT)1(TTC)30(CTC)1(TTC)3N8(TCC)1(TTC)4(CTC)1(TTC)3T(TTC)4N4 N7 (TTC)3N9(TTC)4(TCC)1(TTC)15N23(TTC)4N4 [(TTC)1(CTC)1B](CTC)1(TTC)13 | (TTC)4(CT)1(TTC)30(CTC)1(TTC)3N8(TCC)1(TTC)4(CTC)1(TTC)3T(TTC)4N4 N7 (TTC)3N9(TTC)4(TCC)1(TTC)14N23(TTC)4N4 [(TTC)1(CTC)1B](CTC)1(TTC)13 | | |
| DYS611 | (TTC)6N8(TTC)4(CTC)1(TTC)3N8(TTC)4(CTC)1(TTC)3N15 TTC)4(CT)1(TTC)30(CTC)1(TTC)3N20(TTC)3T(TTC)4(CTC)1(TTC)4N4 N7 (TTC)3N9(TTC)4(TCC)1(TTC)19N23(TTC)4N4 [(TTC)1(CTC)1B](CTC)1(TTC)13 | (TTC)6N8(TTC)4(CTC)1(TTC)3N8(TTC)4(CTC)1(TTC)3N15 TTC)4(CT)1(TTC)30(CTC)1(TTC)3N28(TTC)3T(TTC)4(CTC)1(TTC)4N4 N7 (TTC)3N9(TTC)4(TCC)1(TTC)18N23(TTC)4N4 [(TTC)1(CTC)1B](CTC)1(TTC)13 | 53 | 1339 |
| DYS612 | (CCT)5(CT)1(TCT)4(CCT)1(TCT)27 | (CCT)5(CT)1(TCT)4(CCT)1(TCT)26 | 25 | 4 |
| DYS612 | (CCT)5(CT)1(TCT)4(CCT)1(TCT)25 | (CCT)5(CT)1(TCT)4(CCT)1(TCT)26 | 34 | 104 |
| DYS612 | (CCT)5(CT)1(TCT)4(CCT)1(TCT)26 | (CCT)5(CT)1(TCT)4(CCT)1(TCT)25 | 33 | 127 |
| DYS612 | (CCT)5(CT)1(TCT)4(CCT)1(TCT)27 | (CCT)5(CT)1(TCT)4(CCT)1(TCT)28 | 31 | 141 |
| DYS612 | (CCT)5(CT)1(TCT)4(CCT)1(TCT)25 | (CCT)5(CT)1(TCT)4(CCT)1(TCT)24 | 49 | 161 |
| DYS612 | (CCT)5(CT)1(TCT)4(CCT)1(TCT)26 | (CCT)5(CT)1(TCT)4(CCT)1(TCT)27 | 26 | 248 |
| DYS612 | (CCT)5(CT)1(TCT)4(CCT)1(TCT)25 | (CCT)5(CT)1(TCT)4(CCT)1(TCT)24 | 34 | 253 |
| DYS612 | (CCT)5(CT)1(TCT)4(CCT)1(TCT)25 | (CCT)5(CT)1(TCT)4(CCT)1(TCT)24 | 21 | 593 |
| DYS612 | (CCT)5(CT)1(TCT)4(CCT)1(TCT)24 | (CCT)5(CT)1(TCT)4(CCT)1(TCT)25 | 53 | 689 |
| DYS612 | (CCT)5(CT)1(TCT)4(CCT)1(TCT)35 | (CCT)5(CT)1(TCT)4(CCT)1(TCT)26 | 19 | 696 |
| DYS612 | (CCT)5(CT)1(TCT)4(CCT)1(TCT)22 | (CCT)5(CT)1(TCT)4(CCT)1(TCT)21 | 32 | 770 |
| DYS612 | (CCT)5(CT)1(TCT)4(CCT)1(TCT)25 | (CCT)5(CT)1(TCT)4(CCT)1(TCT)26 | 36 | 839 |
| DYS612 | (CCT)5(CT)1(TCT)4(CCT)1(TCT)26 | (CCT)5(CT)1(TCT)4(CCT)1(TCT)27 | 35 | 875 |
| DYS612 | (CCT)5(CT)1(TCT)4(CCT)1(TCT)24 | (CCT)5(CT)1(TCT)4(CCT)1(TCT)25 | 24 | 935 |
| DYS612 | (CCT)5(CT)1(TCT)4(CCT)1(TCT)26 | (CCT)5(CT)1(TCT)4(CCT)1(TCT)35 | 27 | 1044 |
| DYS612 | (CCT)5(CT)1(TCT)4(CCT)1(TCT)28 | (CCT)5(CT)1(TCT)4(CCT)1(TCT)27 | 21 | 1063 |
| DYS612 | (CCT)5(CT)1(TCT)4(CCT)1(TCT)25 | (CCT)5(CT)1(TCT)4(CCT)1(TCT)24 | Unknown | 1224 |
| DYS612 | (CCT)5(CT)1(TCT)4(CCT)1(TCT)27 | (CCT)5(CT)1(TCT)4(CCT)1(TCT)26 | 49 | 1335 |
| DYS612 | (CCT)5(CT)1(TCT)4(CCT)1(TCT)26 | (CCT)5(CT)1(TCT)4(CCT)1(TCT)25 | 23 | 1359 |
| DYS612 | (CCT)5(CT)1(TCT)4(CCT)1(TCT)25 | (CCT)5(CT)1(TCT)4(CCT)1(TCT)24 | 20 | 1460 |
| DYS612 | (CCT)5(CT)1(TCT)4(CCT)1(TCT)23 | (CCT)5(CT)1(TCT)4(CCT)1(TCT)24 | 36 | 1582 |
| DYS612 | (CCT)5(CT)1(TCT)4(CCT)1(TCT)28 | (CCT)5(CT)1(TCT)4(CCT)1(TCT)27 | Unknown | 1613 |
| DYS612 | (CCT)5(CT)1(TCT)4(CCT)1(TCT)25 | (CCT)5(CT)1(TCT)4(CCT)1(TCT)26 | 41 | 1786 |
| DYS612 | (CCT)5(CT)1(TCT)4(CCT)1(TCT)25 | (CCT)5(CT)1(TCT)4(CCT)1(TCT)24 | 32 | 1792 |
| DYS612 | (CCT)5(CT)1(TCT)4(CCT)1(TCT)25 | (CCT)5(CT)1(TCT)4(CCT)1(TCT)26 | 51 | 1888 |
| DYS614 | (CCT)3N15(CCT)3(CTT)3N2d(CCT)3(CTT)3N15(CCT)3(CTT)3N3(CCT)3(CTT)4(CCT)1(CTT) 3N18 CTT4 [(CTC)1(CTT)1]3 [(CTC)1(CTT)1]1(CTT)5 | (CCT)3(CTT)3N20(CTT)3N15(CCT)3(CTT)3N3(CCT)3(CTT)4(CTT)18N6(CCT)1(CTT)4(CCT)1(CTT)1(CTT)5 | 22 | 219 |
| DYS614 | [(CTC)1(CTT)1]3 [(CTC)1(CTT)1]1(CTT)5 | [(CTC)1(CTT)1]3 (CCT)3N15(CCT)3(CTT)4(CCT)1(CTT)1(CTT)5 | 24 | 655 |

FIGURE 6 [con't]

| Locus | Father Allele | Son Allele | Father's Age | Father Reference # |
|---|---|---|---|---|
| DYS614 | 3N18 [CCT)3(CT)5N20(CT)1(CTG)13(CT)1(GTT)20N8(CTT)4 [CTC)1(CTT)13 [CTC)1(TT)11(CTT)5 | 3N18 (CCT)3(CT)5N20(CT)1(CTG)13(CT)1(GTT)18N8(CTT)4 [CTC)1(CTT)13 [CTC)1(TT)11(CTT)5 | 19 | 916 |
| DYS614 | [CTT)4(CCT)1(CTT)3N15(CCT)4(CTT)1(CTG)1(CT)1(CTT)19N8(CTT)3 [CTC)1(CTT)13 [CTC)1(TT)11(CTT)5 | 3N18 [CTT)4(CCT)1(CTT)3N15(CCT)4(CTT)1(CTG)1(CT)1(CTT)17N8(CTT)5 [CTC)1(CTT)13 [CTC)1(TT)11(CTT)5 | 45 | 1283 |
| DYS614 | (CCT)3(CT)5N20(CT)1(CTG)1(CT)1(GTT)18N8(CTT)4 [CTC)1(CTT)13 [CTC)1(TT)11(CTT)5 | 3N18 (CCT)3(CT)5N20(CT)1(CTG)1(CT)1(GTT)19(CT)1(CTT)18N8(CTT)4 [CTC)1(CTT)13 [CTC)1(TT)11(CTT)5 | 27 | 1583 |
| DYS614 | [CTT)4(CCT)1(CTT)3N15(CCT)4(CTT)1(CT)1(CTT)19N8(CTT)3 [CTC)1(CTT)13 [CTC)1(TT)11(CTT)5 | 3N18 [CTT)4(CCT)1(CTT)3N15(CCT)4(CTT)1(CT)1(CTT)19(CT)1(CTT)11(CTT)5 | 19 | 1764 |
| DYS614 | [CTT)4(CCT)1(CTT)3N15(CCT)4(CTT)1(CT)1(CTT)19N8(CTT)3 [CTC)1(CTT)13 [CTC)1(TT)11(CTT)5 | 3N18 [CTT)4(CCT)1(CTT)3N15(CCT)4(CTT)1(CT)1(CTT)18N8(CTT)5 [CTC)1(CTT)13 [CTC)1(TT)11(CTT)5 | 52 | 1965 |
| DYS615 | [CTC)1(CTT)13 [CTC)1(TT)11(CTT)5 (TAT)15(CAT)1(TAT)3 | [CTC)1(CTT)15 [CTC)1(TT)11(CTT)5 (TAT)15(CAT)1(TAT)3 | 25 | 40 |
| DYS616 | (TAT)15(CAT)1(TAT)3 | (TAT)14(CAT)1(TAT)3 | 41 | 417 |
| DYS622 | (GAAA)5(AGAAG)1(GAAA)12 | (GAAA)8(AGAAG)1(GAAA)13 | 33 | 187 |
| DYS622 | (GAAA)6(AGAAG)1(GAAA)14 | (GAAA)6(AGAAG)1(GAAA)15 | 34 | 309 |
| DYS622 | (GAAA)5(AGAAG)1(GAAA)14 | (GAAA)6(AGAAG)1(GAAA)13 | 30 | 642 |
| DYS622 | (GAAA)6(AGAAG)1(GAAA)11 | (GAAA)6(AGAAG)1(GAAA)10 | 19 | 1006 |
| DYS623 | (GAAA)6(AGAAG)1(GAAA)13 | (GAAA)6(AGAAG)1(GAAA)12 | 21 | 1436 |
| DYS625 | (CTT)4(TT)1(CTT)4(CCT)1(CTT)3N10(CTT)3 3N47 | (CTT)4(TT)1(CTT)4(CCT)1(CTT)4(TT)1(CTT)3 3N47 | 39 | 445 |
| DYS626 | (GAAA)19N24(GAAA)3N6(GAAA)1 (GAAA)2(GAAG)1(GAAA)3 | (GAAA)20N24(GAAA)3N6(GAAA)5(AAA)1 (GAAA)2(GAAG)1(GAAA)3 | 42 | 383 |
| DYS626 | (GAAA)16N24(GAAA)3N6(GAAA)5(AAA)1 | (GAAA)17N24(GAAA)3N6(GAAA)5(AAA)1 | 37 | 368 |

FIGURE 6 [con't]

| Locus | Father Allele | Son Allele | Father's Age | Father Reference # |
|---|---|---|---|---|
| DYS626 | (GAAA)17N24(GAAA)3N6(GAAA)5(AAAA)1(GAAA)2(GAAG)11(GAAA)3 | (GAAA)17N24(GAAA)3N6(GAAA)5(AAAA)1(GAAA)2(GAAG)11(GAAA)3 | 35 | 505 |
| DYS626 | (GAAA)18N24(GAAA)3N6(GAAA)5(AAAA)1(GAAA)2(GAAG)11(GAAA)3 | (GAAA)18N24(GAAA)3N6(GAAA)5(AAAA)1(GAAA)2(GAAG)11(GAAA)3 | 38 | 529 |
| DYS626 | (GAAA)19N24(GAAA)3N6(GAAA)5(AAAA)1(GAAA)2(GAAG)11(GAAA)3 | (GAAA)17N24(GAAA)3N6(GAAA)5(AAAA)1(GAAA)2(GAAG)11(GAAA)3 | 24 | 571 |
| DYS626 | (GAAA)18N24(GAAA)3N6(GAAA)5(AAAA)1(GAAA)2(GAAG)11(GAAA)3 | (GAAA)19N24(GAAA)3N6(GAAA)5(AAAA)1(GAAA)2(GAAG)11(GAAA)3 | 40 | 612 |
| DYS626 | (GAAA)17N24(GAAA)3N6(GAAA)5(AAAA)1(GAAA)2(GAAG)11(GAAA)3 | (GAAA)18N24(GAAA)3N6(GAAA)5(AAAA)1(GAAA)2(GAAG)11(GAAA)3 | 29 | 650 |
| DYS626 | (GAAA)19N24(GAAA)3N6(GAAA)5(AAAA)1(GAAA)2(GAAG)11(GAAA)3 | (GAAA)19N24(GAAA)3N6(GAAA)5(AAAA)1(GAAA)2(GAAG)11(GAAA)3 | 35 | 733 |
| DYS626 | (GAAA)18N24(GAAA)3N6(GAAA)5(AAAA)1(GAAA)2(GAAG)11(GAAA)3 | (GAAA)19N24(GAAA)3N6(GAAA)5(AAAA)1(GAAA)2(GAAG)11(GAAA)3 | 41 | 779 |
| DYS626 | (GAAA)20N24(GAAA)3N6(GAAA)5(AAAA)1(GAAA)2(GAAG)11(GAAA)3 | (GAAA)19N24(GAAA)3N6(GAAA)5(AAAA)1(GAAA)2(GAAG)11(GAAA)3 | 29 | 901 |
| DYS626 | (GAAA)20N24(GAAA)3N6(GAAA)5(AAAA)1(GAAA)2(GAAG)11(GAAA)3 | (GAAA)20N24(GAAA)3N6(GAAA)5(AAAA)1(GAAA)2(GAAG)11(GAAA)3 | 27 | 953 |
| DYS626 | (GAAA)19N24(GAAA)3N6(GAAA)5(AAAA)1(GAAA)2(GAAG)11(GAAA)3 | (GAAA)20N24(GAAA)3N6(GAAA)5(AAAA)1(GAAA)2(GAAG)11(GAAA)3 | 39 | 1071 |
| DYS626 | (GAAA)17N24(GAAA)3N6(GAAA)5(AAAA)1(GAAA)2(GAAG)11(GAAA)3 | (GAAA)11N24(GAAA)3N6(GAAA)5(AAAA)1(GAAA)2(GAAG)11(GAAA)3 | 17 | 1109 |
| DYS626 | (GAAA)18N24(GAAA)3N6(GAAA)5(AAAA)1(GAAA)2(GAAG)11(GAAA)3 | (GAAA)20N24(GAAA)3N6(GAAA)5(AAAA)1(GAAA)2(GAAG)11(GAAA)3 | 35 | 1112 |
| DYS626 | (GAAA)19N24(GAAA)3N6(GAAA)5(AAAA)1(GAAA)2(GAAG)11(GAAA)3 | (GAAA)20N24(GAAA)3N6(GAAA)5(AAAA)1(GAAA)2(GAAG)11(GAAA)3 | 27 | 1389 |
| DYS626 | (GAAA)16N24(GAAA)3N6(GAAA)5(AAAA)1(GAAA)2(GAAG)11(GAAA)3 | (GAAA)16N24(GAAA)3N6(GAAA)5(AAAA)1(GAAA)2(GAAG)11(GAAA)3 | 25 | 1445 |
| DYS626 | (GAAA)16N24(GAAA)3N6(GAAA)5(AAAA)1(GAAA)2(GAAG)11(GAAA)3 | (GAAA)19N24(GAAA)3N6(GAAA)5(AAAA)1(GAAA)2(GAAG)11(GAAA)3 | 25 | 1514 |
| DYS626 | (GAAA)18N24(GAAA)3N6(GAAA)5(AAAA)1(GAAA)2(GAAG)11(GAAA)3 | (GAAA)19N24(GAAA)3N6(GAAA)5(AAAA)1(GAAA)2(GAAG)11(GAAA)3 | 19 | 1530 |
| DYS626 | (GAAA)19N24(GAAA)3N6(GAAA)5(AAAA)1(GAAA)2(GAAG)11(GAAA)3 | (GAAA)20N24(GAAA)3N6(GAAA)5(AAAA)1(GAAA)2(GAAG)11(GAAA)3 | 59 | 1823 |
| DYS626 | (GAAA)22N24(GAAA)3N6(GAAA)5(AAAA)1(GAAA)2(GAAG)11(GAAA)3 | (GAAA)21N24(GAAA)3N6(GAAA)5(AAAA)1(GAAA)2(GAAG)11(GAAA)3 | 56 | 1907 |
| DYS627 | (AGAA)3N16(AGAG)3(AAAG)21N81(AAGG)3 | (AGAA)3N16(AGAG)3(AAAG)21N81(AAGG)3 | 25 | 4 |
| DYS627 | (AGAA)3N16(AGAG)3(AAAG)22N81(AAGG)3 | (AGAA)3N16(AGAG)3(AAAG)21N81(AAGG)3 | 38 | 49 |
| DYS627 | (AGAA)3N16(AGAG)3(AAAG)18N81(AAGG)3 | (AGAA)3N16(AGAG)3(AAAG)19N81(AAGG)3 | 29 | 82 |
| DYS627 | (AGAA)3N16(AGAG)3(AAAG)18N81(AAGG)3 | (AGAA)3N16(AGAG)3(AAAG)19N81(AAGG)3 | 39 | 112 |

FIGURE 6 [con't]

| Locus | Father Allele | Son Allele | Father's Age | Father Reference # |
|---|---|---|---|---|
| DYS627 | (AGAA)3N16(AGAG)3(AAAG)19N81(AAGG)3 | (AGAA)3N16(AGAG)3(AAAG)18N81(AAGG)3 | 27 | 170 |
| DYS627 | (AGAA)3N16(AGAG)3(AAAG)20N81(AAGG)3 | (AGAA)3N16(AGAG)3(AAAG)19N81(AAGG)3 | 34 | 243 |
| DYS627 | (AGAA)3N16(AGAG)3(AAAG)18N81(AAGG)3 | (AGAA)3N16(AGAG)3(AAAG)18N81(AAGG)3 | 20 | 256 |
| DYS627 | (AGAA)3N16(AGAG)3(AAAG)19N81(AAGG)3 | (AGAA)3N16(AGAG)3(AAAG)20N81(AAGG)3 | 21 | 328 |
| DYS627 | (AGAA)3N16(AGAG)3(AAAG)18N81(AAGG)3 | (AGAA)3N16(AGAG)3(AAAG)18N81(AAGG)3 | 31 | 331 |
| DYS627 | (AGAA)3N15(AGAG)3(AAAG)19N81(AAGG)3 | (AGAA)3N16(AGAG)3(AAAG)17N81(AAGG)3 | 37 | 365 |
| DYS627 | (AGAA)3N16(AGAG)3(AAAG)20N81(AAGG)3 | (AGAA)3N16(AGAG)3(AAAG)21N81(AAGG)3 | 23 | 496 |
| DYS627 | (AGAA)3N16(AGAG)3(AAAG)23N81(AAGG)3 | (AGAA)3N16(AGAG)3(AAAG)22N81(AAGG)3 | 35 | 599 |
| DYS627 | (AGAA)3N16(AGAG)3(AAAG)20N81(AAGG)3 | (AGAA)3N16(AGAG)3(AAAG)19N81(AAGG)3 | 36 | 619 |
| DYS627 | (AGAA)3N16(AGAG)3(AAAG)20N81(AAGG)3 | (AGAA)3N16(AGAG)3(AAAG)19N81(AAGG)3 | 25 | 711 |
| DYS627 | (AGAA)3N16(AGAG)3(AAAG)19N81(AAGG)3 | (AGAA)3N16(AGAG)3(AAAG)18N81(AAGG)3 | 20 | 742 |
| DYS627 | (AGAA)3N16(AGAG)3(AAAG)19N81(AAGG)3 | (AGAA)3N16(AGAG)3(AAAG)20N81(AAGG)3 | 29 | 789 |
| DYS627 | (AGAA)3N16(AGAG)3(AAAG)19N81(AAGG)3 | (AGAA)3N16(AGAG)3(AAAG)20N81(AAGG)3 | Unknown | 1310 |
| DYS627 | (AGAA)3N16(AGAG)3(AAAG)15N81(AAGG)3 | (AGAA)3N16(AGAG)3(AAAG)16N81(AAGG)3 | 22 | 1323 |
| DYS627 | (AGAA)3N16(AGAG)3(AAAG)18N81(AAGG)3 | (AGAA)3N16(AGAG)3(AAAG)19N81(AAGG)3 | 42 | 1407 |
| DYS627 | (AGAA)3N16(AGAG)3(AAAG)22N81(AAGG)3 | (AGAA)3N16(AGAG)3(AAAG)23N81(AAGG)3 | 17 | 1416 |
| DYS627 | (AGAA)3N16(AGAG)3(AAAG)18N81(AAGG)3 | (AGAA)3N16(AGAG)3(AAAG)26N81(AAGG)3 | 54 | 1860 |
| DYS629 | (TATC)9 | (TATC)10 | 29 | 509 |
| DYS630 | (AAAG)4(AGAG)3N18(AAAG)14 | (AAAG)4(AGAG)3N18(AAAG)15 | 21 | 46 |
| DYS630 | (AAAG)4(AGAG)3N18(AAAG)15 | (AAAG)4(AGAG)3N18(AAAG)14 | 35 | 63 |
| DYS630 | (AAAG)4(AGAG)3N18(AAAG)18 | (AAAG)4(AGAG)3N18(AAAG)17 | 23 | 96 |
| DYS630 | (AAAG)4(AGAG)3N18(AAAG)16 | (AAAG)4(AGAG)3N18(AAAG)15 | 40 | 255 |
| DYS630 | (AAAG)4(AGAG)3N18(AAAG)15 | (AAAG)4(AGAG)3N18(AAAG)16 | 30 | 448 |
| DYS630 | (AAAG)4(AGAG)3N18(AAAG)13 | (AAAG)4(AGAG)3N18(AAAG)14 | 21 | 473 |
| DYS630 | (AAAG)4(AGAG)3N18(AAAG)17 | (AAAG)4(AGAG)3N18(AAAG)18 | 39 | 501 |
| DYS630 | (AAAG)4(AGAG)3N18(AAAG)14 | (AAAG)4(AGAG)3N18(AAAG)15 | 36 | 665 |
| DYS631 | (AATA)4(CATA)11(AATA)11 | (AATA)4(CATA)11(AATA)10 | 47 | 347 |
| DYS635 | (TCTA)4(TGTA)2(TCTA)2(TGTA)2(TCTA)12 14 | (TCTA)4(TGTA)2(TCTA)2(TGTA)2(TCTA)11 | 53 | 35 |
| DYS635 | (TCTA)4(TGTA)2(TCTA)2(TGTA)2(TCTA)13 | (TCTA)4(TGTA)2(TCTA)2(TGTA)2(TCTA)12 | 33 | 528 |
| DYS635 | (TCTA)4(TGTA)2(TCTA)2(TGTA)2(TCTA)13 | (TCTA)4(TGTA)2(TCTA)2(TGTA)2(TCTA)12 | 36 | 517 |
| DYS635 | (TCTA)4(TGTA)2(TCTA)2(TGTA)2(TCTA)12 | (TCTA)4(TGTA)2(TCTA)2(TGTA)2(TCTA)11 | 26 | 699 |
| DYS635 | (TCTA)4(TGTA)2(TCTA)2(TGTA)2(TCTA)12 | (TCTA)4(TGTA)2(TCTA)2(TGTA)2(TCTA)11 | 29 | 1674 |
| DYS635 | (TCTA)4(TGTA)2(TCTA)2(TGTA)2(TCTA)11 | (TCTA)4(TGTA)2(TCTA)2(TGTA)2(TCTA)12 | 52 | 1391 |
| DYS637 | (AAAT)4(ACAT)11 | (AAAT)4(ACAT)10 | 25 | 949 |
| DYS638 | (TTTA)11 | (TTTA)12 | 56 | 1677 |
| DYS643 | (AAAT)11 | (AAAT)12 | 32 | 85 |
| DYS643 | (AAAT)13 | (AAAT)14 | 19 | 1697 |
| DYS644 | (TTTA)10(TTTA)7 | (TTTA)10(TTTA)8 | 22 | 467 |
| DYS644 | (TTTA)10(TTTA)6 | (TTTA)10(TTTA)5 | 24 | 631 |

FIGURE 6 [con't]

| Locus | Father Allele | Son Allele | Father's Age | Father Reference # |
|---|---|---|---|---|
| DYS644 | (TTTA)10(TTTA)13 | (TTTA)11(TTTA)1(TTTA)13 | 21 | 1667 |
| DYS644 | (TTTA)10(TTTA)6 | (TTTA)10(TTTA)7 | 19 | 1717 |
| DYS644 | (TTTA)10(TTTA)7 | (TTTA)10(TTTA)6 | 50 | 1832 |

FIGURE 7

| Number of Meioses Separating Pair | RM Y-STR Mutations | RM Y-STR Locus Comparisons | Y filer Mutations | Y filer Locus Comparisons |
|---|---|---|---|---|
| 1 | 1 | 9 | 0 | 17 |
| 1 | 1 | 12 | 0 | 17 |
| 1 | 1 | 10 | 0 | 17 |
| 1 | 1 | 11 | 0 | 17 |
| 1 | 1 | 10 | 0 | 17 |
| 1 | 2 | 12 | 0 | 17 |
| 1 | 0 | 5 | 0 | 16 |
| 1 | 1 | 13 | 0 | 17 |
| 1 | 0 | 12 | 0 | 17 |
| 1 | 0 | 13 | 0 | 17 |
| 1 | 1 | 13 | 0 | 17 |
| 1 | 0 | 13 | 0 | 17 |
| 1 | 0 | 11 | 0 | 17 |
| 1 | 3 | 10 | 0 | 17 |
| 1 | 1 | 13 | 0 | 17 |
| 1 | 0 | 10 | 0 | 17 |
| 1 | 1 | 4 | 0 | 15 |
| 1 | 1 | 12 | 0 | 17 |
| 1 | 1 | 12 | 0 | 17 |
| 2 | 2 | 11 | 0 | 17 |
| 2 | 1 | 8 | 0 | 17 |
| 2 | 2 | 11 | 0 | 17 |
| 2 | 2 | 13 | 0 | 17 |
| 2 | 2 | 9 | 0 | 17 |
| 2 | 2 | 13 | 0 | 17 |
| 2 | 0 | 13 | 0 | 17 |
| 2 | 0 | 13 | 0 | 17 |
| 2 | 0 | 13 | 0 | 17 |
| 2 | 1 | 13 | 0 | 17 |
| 2 | 0 | 12 | 0 | 17 |
| 2 | 3 | 13 | 0 | 17 |
| 2 | 0 | 10 | 0 | 17 |
| 2 | 0 | 13 | 1 | 17 |
| 2 | 0 | 13 | 0 | 17 |
| 2 | 3 | 10 | 0 | 17 |

FIGURE 7 [con't]

| Number of Meioses Separating Pair | RM Y-STR Mutations | RM Y-STR Locus Comparisons | Yfiler Mutations | Yfiler Locus Comparisons |
|---|---|---|---|---|
| 2 | 0 | 12 | 0 | 17 |
| 2 | 4 | 13 | 0 | 17 |
| 2 | 1 | 13 | 0 | 17 |
| 2 | 3 | 13 | 0 | 17 |
| 2 | 0 | 13 | 0 | 17 |
| 2 | 0 | 13 | 0 | 17 |
| 2 | 0 | 13 | 1 | 17 |
| 2 | 1 | 13 | 0 | 17 |
| 2 | 0 | 10 | 0 | 17 |
| 2 | 1 | 13 | 0 | 17 |
| 2 | 2 | 3 | 0 | 17 |
| 2 | 0 | 13 | 0 | 17 |
| 2 | 0 | 13 | 0 | 17 |
| 3 | 2 | 12 | 0 | 17 |
| 3 | 2 | 13 | 0 | 17 |
| 3 | 2 | 13 | 0 | 17 |
| 3 | 3 | 13 | 0 | 17 |
| 3 | 0 | 13 | 0 | 17 |
| 3 | 1 | 13 | 0 | 17 |
| 4 | 1 | 5 | 0 | 17 |
| 4 | 1 | 13 | 0 | 17 |
| 5 | 1 | 12 | 0 | 17 |
| 5 | 2 | 9 | 2 | 17 |
| 5 | 3 | 10 | 0 | 17 |
| 6 | 1 | 12 | 1 | 17 |
| 6 | 5 | 13 | 0 | 17 |
| 6 | 3 | 13 | 0 | 17 |
| 6 | 4 | 10 | 0 | 17 |
| 6 | 3 | 13 | 1 | 17 |
| 7 | 0 | 13 | 0 | 17 |
| 7 | 2 | 13 | 0 | 17 |
| 8 | 4 | 13 | 0 | 17 |
| 8 | 3 | 12 | 0 | 17 |
| 8 | 2 | 13 | 0 | 17 |

FIGURE 7 [con't]

| Number of Meioses Separating Pair | BM Y-STR Mutations | BM Y-STR Locus Comparisons | Yfiler Mutations | Yfiler Locus Comparisons |
|---|---|---|---|---|
| 8 | 0 | 13 | 0 | 17 |
| 8 | 0 | 13 | 1 | 17 |
| 9 | 4 | 13 | 0 | 17 |
| 9 | 2 | 13 | 0 | 17 |
| 9 | 1 | 13 | 1 | 17 |
| 10 | 1 | 13 | 0 | 17 |
| 10 | 4 | 12 | 1 | 17 |
| 10 | 2 | 13 | 0 | 17 |
| 10 | 3 | 13 | 0 | 17 |
| 10 | 3 | 12 | 1 | 17 |
| 10 | 1 | 12 | 2 | 17 |
| 10 | 0 | 12 | 1 | 17 |
| 11 | 6 | 13 | 0 | 17 |
| 11 | 0 | 13 | 0 | 17 |
| 11 | 3 | 12 | 2 | 17 |
| 11 | 4 | 13 | 1 | 17 |
| 11 | 1 | 13 | 0 | 17 |
| 13 | 3 | 12 | 1 | 17 |
| 13 | 4 | 12 | 0 | 17 |
| 13 | 5 | 13 | 0 | 17 |
| 20 | 4 | 13 | 0 | 17 |
| Total | 158 | 1246 | 17 | 1751 |
| Average | 1.53 | 12.10 | 0.17 | 17 |

ANALYSIS OF Y-CHROMOSOME STR MARKERS

This application is a Continuation of U.S. application Ser. No. 15/947,750 filed Apr. 6, 2018, which is a Continuation of U.S. application Ser. No. 14/624,185 filed Feb. 17, 2015 (abandoned), which is a Continuation of U.S. application Ser. No. 13/613,578 filed Sep. 13, 2012 (abandoned), which is a Continuation of U.S. application Ser. No. 12/880,040 filed Sep. 10, 2010 (abandoned), which claims the benefit of priority under 35 U.S.C. § 119(e) to U.S. Provisional Application No. 61/241,778 filed Sep. 11, 2009; U.S. Provisional Application No. 61/367,346 filed Jul. 23, 2010; and U.S. Provisional Application No. 61/379,340 filed Sep. 1, 2010. All the aforementioned applications are incorporated herein by reference in their entirety.

FIELD

Embodiments of the subject inventions are in the field of the forensic analysis of DNA.

BACKGROUND

The use of STR markers has become a standard tool in the analysis of DNA found at crime scenes. In most cases, the use of autosomal STR markers are used because, in part, of the high level of polymorphisms within most populations. For example, the 13 CODIS loci that are the standard for databasing criminal suspect in DNA in the United States are autosomal STR markers. In many cases with mixed stains from male and female contributors, particularly rape cases, forensic investigators must analyze genetic markers found on the Y chromosome to identify the male component usually belonging to the perpetrator of the crime. This is because in such cases, the autosomal STR markers are not informative due to profile overlap between e.g. female victim DNA and male perpetrator DNA. Although there are technical possibilities (i.e. differential lysis) to preferentially access male DNA, such techniques are often not successful. Because female DNA lacks a Y chromosome, the analysis of Y chromosomal markers can be used in samples that contained high levels of female DNA relative to the male DNA in the sample. Analyzing the Y chromosomal DNA hence excludes the complicating artifacts caused by the excess female source DNA.

The non-recombining nature allows the use of Y chromosome markers for male lineage identification, i.e. groups of males that are paternally related and hence share the same Y-STR haplotype i.e. based on currently-used Y-STR markers in forensics. Male lineage identification has become a valuable tool in forensic genetics to exclude males. However, in cases of non-exclusion (i.e. matching Y-STR profiles) no individual-based statement can be made based on the currently-available Y-STR markers because the same probability of having donated the crime scene sample applies to a male suspect and all his male relatives. This clearly is a limitation in forensic application where individual-based conclusions are anticipated. However, mutation events can occur at Y-STR markers. These mutations in the Y-STR marker can in principle enable the investigator to distinguish between closely related male relatives, and also between more distantly related males, provided such mutations occur in high-enough frequencies to be observable in a give pair of male relatives. Mutations in the currently available Y-STR markers are fairly infrequent events, occurring on the order of about 0.1 to 0.4% (1-4 changes per thousand generational events per each Y-STR locus). Thus even when relatively large numbers of Y-STR markers, i.e. those 17 markers applied to forensic applications today, are used the probability of distinguishing between male relatives is still remote. However, if enough Y-STRs markers that mutate more rapidly than the currently-known Y-STRs would be available, it can be expected that closely related males as well as distantly related males become differentiable based on Y-STR mutations towards male individual identification as anticipated in forensic applications.

The inventors have discovered a subset of thirteen Y-STR markers that have a significantly higher mutation rate than most Y-STR markers including those that are in general use. This finding is expected to revolutionize Y chromosomal applications in forensic biology, from previous male lineage differentiation methods. This finding also leads the way for male individual identification. Thus, by using one or more, by using two or more of such rapidly-mutating Y-STR markers (RM Y-STRs), the ability to distinguish between close and distantly related male relatives is significantly increased.

SUMMARY

Certain embodiments of the invention include methods of identifying an individual by determining the allele of at least 2 Y-STR markers selected from the group consisting of the rapidly-mutating Y-STR markers: DYF387S1, DYF399S1, DYF403S1, DYF404S1, DYS449, DYS518, DYS526, DYS547, DYS570, DYS576, DYS612, DYS626 and DYS627. In some embodiments of the subject methods, the alleles can be identified by PCR. In some embodiments of the subject methods, the alleles can be identified by mass spectroscopy. The PCR can be multiplexed PCR so as to co-amplify the at least 2 of the rapidly-mutating Y-STR markers. Certain embodiments of the invention include set of amplification primer pairs comprising primers for the amplification of at least 2 Y-STR markers selected from the group consisting of DYF387S1, DYF399S1, DYF403S1, DYF404S1, DYS449, DYS518, DYS526, DYS547, DYS570, DYS576, DYS612, DYS626 and DYS627. The primers set can co-amplify at least 2-13 of the rapidly-mutating Y-STR markers. In certain embodiments the primer set can co-amplify autosomal STR markers in addition to rapidly-mutating Y-STR markers. In some embodiments, the autosomal STRs can be selected from the group consisting of D3S1358, vWA, FGA, D8S1179, D21S11, D18S51, D5S818, D13S317, D7S820, D16S539, THO1, TPOX, and CSF1PO. In some embodiments the primers can be labeled with a fluorescent dye. Other embodiments provided are allelic ladder size standard for calling one or more alleles of an STR from at least 2 of the Y-STR markers selected from the group consisting of DYF387S1, DYF399S1, DYF403S1, DYF404S1, DYS449, DYS518, DYS526, DYS547, DYS570, DYS576, DYS612, DYS626 and DYS627. Other embodiments provided are kits for identifying the allele of at least 2 Y chromosome STRS markers, wherein the markers are selected from the group consisting of DYF387S1, DYF399S1, DYF403S1, DYF404S1, DYS449, DYS518, DYS526, DYS547, DYS570, DYS576, DYS612, DYS626 and DYS627, the kit comprising primers for the amplification of at least 2 rapidly-mutating Y-STR markers, and an allelic ladder representative of the selected markers.

BRIEF DESCRIPTION OF THE DRAWINGS AND TABLES

FIG. 1. Mutation rates of 186 Y-STR markers established from father-son pair analysis. Distribution of 186 Y-STR markers according to their Bayesian-based mutation rates (with credible intervals) estimated from analyzing up to 1966 DNA confirmed father-son pairs per each marker. The 13 rapidly-mutation (RM) Y-STR markers ascertained for further family/pedigree analysis are highlighted in red, and the commonly-used 17 Yfiler Y-STRs are in green. Multi-copy Y-STRs are noted with a black insert diamond.

Figure 2:
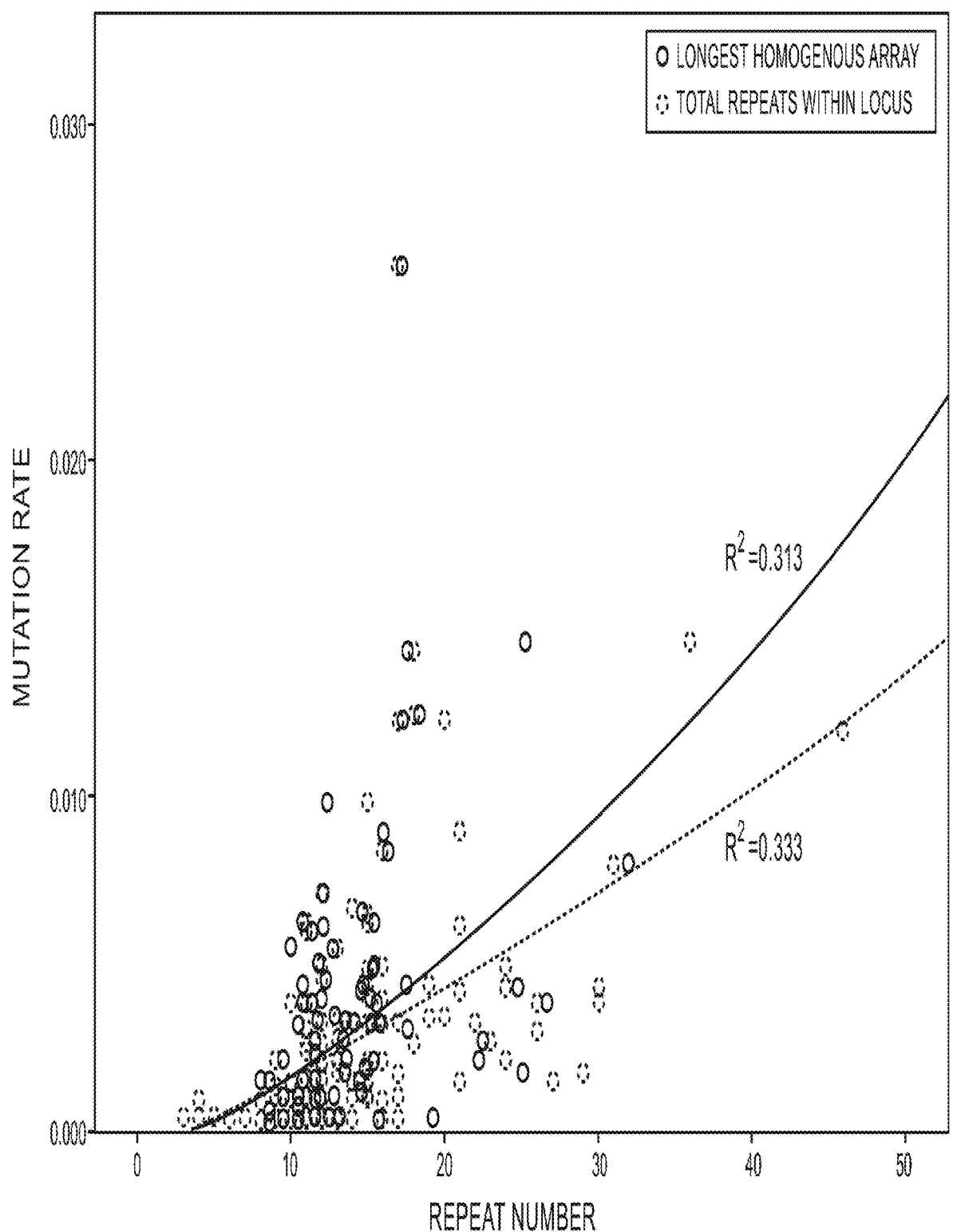

FIG. 2. Correlation between the length of the longest homogeneous array, or the total number of repeats within a locus, and the allele-specific mutation rate from 267 Y-STR loci. Although the number of repeats present within a locus" longest homogenous array can be used to predict mutability, the total number of all repeats present within the locus has higher predictive value.

Figure 3:
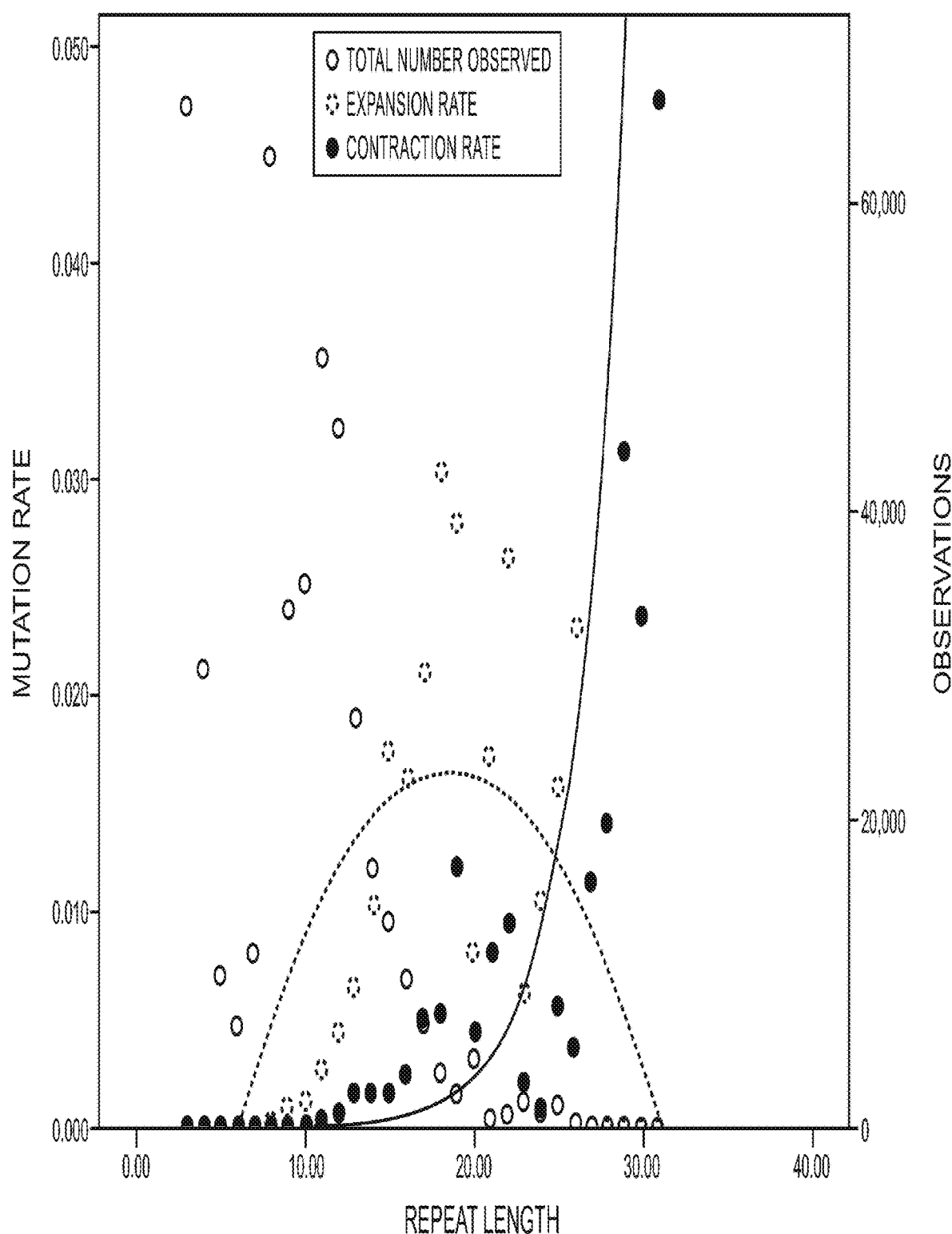

FIG. 3. Relationship between total number of repeats and mutation direction and rate from 267 Y-STR loci. Repeat loss mutations (contractions) displayed an exponential relationship with the total number of repeats, with increasing rates of loss rates at loci with higher numbers of repeats. Repeat gain mutations (expansions) showed a weak quadratic function, with a peak in gain rate at 20 total repeats.

Figure 4:
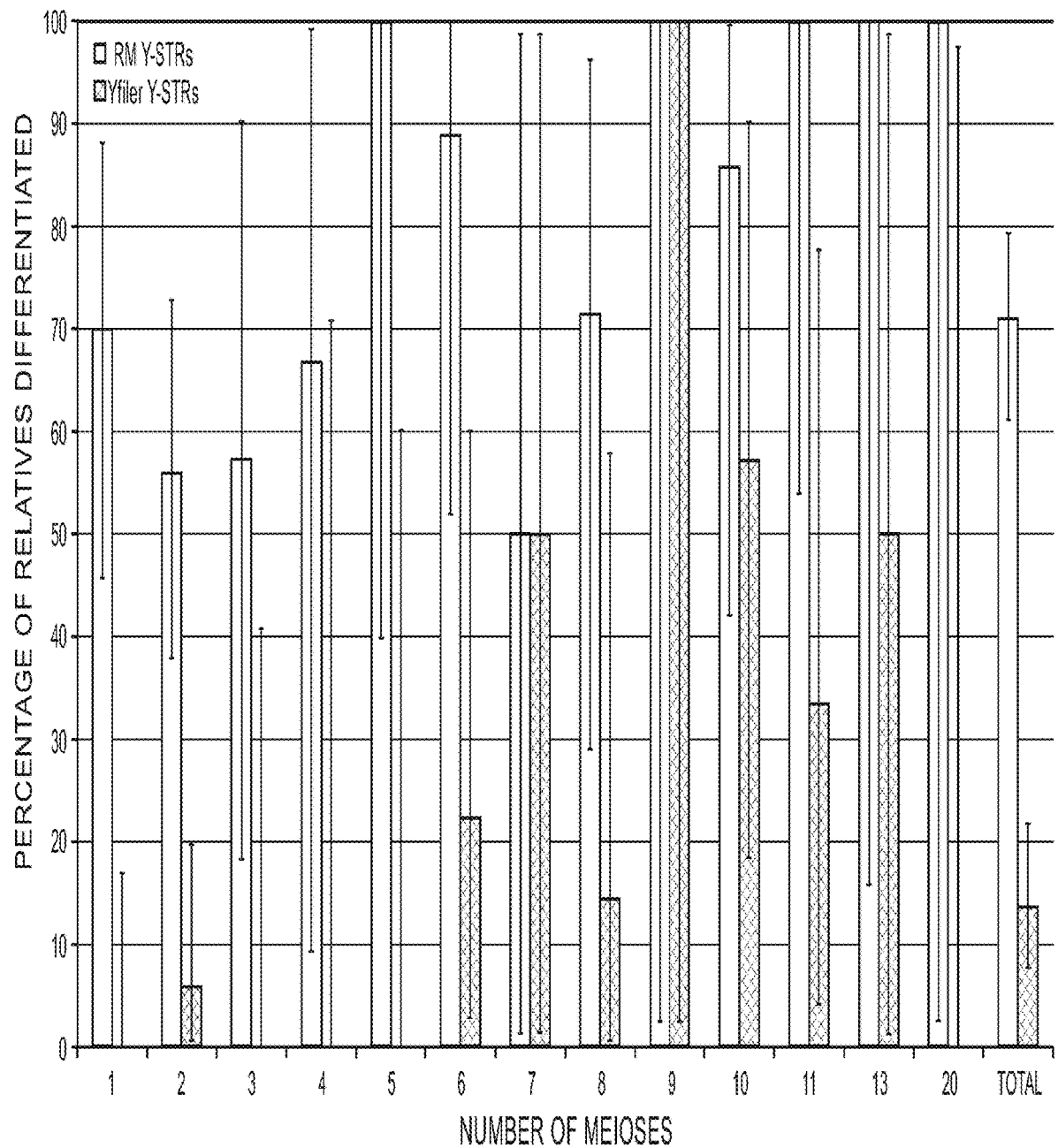

FIG. 4. Male relative differentiation with newly-identified 13 RM Y-STRs and commonly-used 17 Yfiler Y-STRs. Results from differentiating between male relatives from analyzing 103 pairs from 80 male pedigrees, sorted according to the number of generations separating pedigree members, based on 13 RM Y-STRs and 17 Yfiler Y-STRs. Error bars represent 95% binomial confidence intervals. Note that these samples are independent from the father-son pairs initially used to establish the Y-STR mutation rates.

FIGS. 5A-5C. FIG. 5A: Mutation rate estimations from the posterior distributions (medians and 95% credible intervals) of 186 Y-STR markers from analyzing up to 1966 DNA-confirmed father-son pairs. Markers with median mutation rates above $10^{-2}$ (the RM Y-STR set) are highlighted. Additionally included are marker repeat structures (SEQ ID NOS 1-187, respectively, in order of appearance), number of gains/losses, total mutations and total number of father-son transmissions observed. FIG. 5B: PCR primers (Primer 1 sequences disclosed as SEQ ID NOS 188-357 and Primer 2 sequences disclosed as SEQ ID NOS 358-527, respectively, in order of appearance). FIG. 5C: PCR annealing temperature and locus assignment to the 54 multiplexes and three RM Y-STR multiplexes used for genotyping are included.

FIG. 6. Details of the 924 mutations observed among 120 Y-STR markers from screening a total of 352,999 meiotic transfers at 186 Y-STR markers. The repeat structure of both the father and son's alleles at the mutated Y-STR are given where possible (SEQ ID NOS 528-2196, respectively, in order of appearance). In the case of multi-copy markers with multiple variable segments within the amplicon, total repeat numbers or amplicon size is given in the absence of sequence information. The age of the father at the time of the son's birth is given, as is an individual pair reference.

FIG. 7. Comparison of 13 rapidly mutating RM Y-STRs and 17 Yfiler Y-STRs to differentiate between male relatives by one or more mutations from analyzing 103 pairs from 80 male pedigrees according to the number of generations separating members of the same pedigree.

DEFINITIONS

A "mutation" in a Y-STR marker is a change in the length of the repeat region of an STR marker or a change in the length (i.e., number) of the bases that are interspersed with the repeat units. For example, the addition of one more repeat unit is mutation resulting in the appearance of a new allele. In another example, the addition of a single base within a single repeat unit is also a mutation resulting in the appearance of a new allele. Such changes can result form the addition or deletion of one or more repeat units (or fractions thereof). Such sequence changes are readily detected by methods of analysis that are capable of detecting variations in nucleic acid sequence length or nucleic acid base order.

The term "rapidly-mutating Y-STR marker" (RM Y-STRs) as used herein refers to the following 11 Y-STR markers: DYF387S1, DYF399S1, DYF404S1, DYS449, DYS526, DYS547, DYS570, DYS576, DYS612, DYS626 and DYS627.

As used herein, the term "allelic ladder" refers to a standard size marker consisting of amplified alleles from a given STR locus or a size standards equivalent in size (or electrophoretic mobility) to the amplified alleles from a given STR locus. An allelic ladder can comprise a size standard for one or more alleles of a given STR marker. An allelic ladder can include alleles from different STR markers. The size standards in an allelic ladder can be labeled with a detectable label, e.g., a fluorescent dye.

The term "Y-STR marker" as used herein refers to an STR marker that is present on the non-recombining part of the human Y chromosome. Over 250 such Y-STR markers exist based on current knowledge. Y-STR markers are well-known to the person ordinary skill in the art. Database of Y-STR marker are publicly available, for example, at web sites, www.usystrdatabase.org and www.yhrd.org The term "STR" as used herein refers to regions of genomic DNA which contain short, repetitive sequence elements. The sequence elements that are repeated are not limited to but are generally three to seven base pairs in length. Each sequence element is repeated at least once within an STR and is referred to herein as a "repeat unit." The term STR also encompasses a region of genomic DNA wherein more than a single repeat unit is repeated in tandem or with intervening bases, provided that at least one of the sequences is repeated at least two times in tandem.

The term "Primer" as used herein refers to a single-stranded oligonucleotide or DNA fragment that hybridizes with a DNA strand of a locus in such a manner that the 3' terminus of the primer can act as a site of polymerization and extension using a DNA polymerase enzyme. Primers can also DNA analogs in additions to or instead of naturally occurring DNA, e.g., LNAs, base analogs, and the like. "Primer pair" refers to two primers comprising a primer 1 that hybridizes to a single strand at one end of the DNA sequence to be amplified, and a primer 2 that hybridizes with the other end on the complementary strand of the DNA sequence to be amplified. "Primer site" refers to the area of the target DNA to which a primer hybridizes.

As used herein, the terms "a," "an," and "the" and similar referents used herein are to be construed to cover both the singular and the plural unless their usage in context indicates otherwise. Accordingly, the use of the word "a" or "an" when used in conjunction with the term "comprising" in the claims or specification may mean "one," but it is also consistent with the meaning of "one or more," "at least one," and "one or more than one." It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

Unless defined otherwise, all technical and scientific terms used herein have the same meaning as is commonly understood by one of ordinary skill in the art to which these inventions belong. All patents, patent applications, published applications, treatises and other publications referred to herein, both supra and infra, are incorporated by reference in their entirety. If a definition and/or description is set forth herein that is contrary to or otherwise inconsistent with any definition set forth in the patents, patent applications, published applications, and other publications that are herein incorporated by reference, the definition and/or description set forth herein prevails over the definition that is incorporated by reference. The citation of any publication is for its disclosure prior to the filing date and should not be construed as an admission that the present invention is not entitled to antedate such publication by virtue of prior invention.

Description of Certain Specific Embodiments

Applicants have identified mutation rates for numerous Y-STRs by examining three areas: i) the lack of knowledge on Y-STR mutability based on a reasonably large number of loci as required for evolutionary and genealogical applications, ii) the limited knowledge on the molecular basis of Y-STR mutability, and iii) the lack of Y-STRs for familial differentiation in forensic, genealogical, and particular population applications.

In ~2000 DNA-confirmed father-son pairs. The Table in FIG. 5A presents the mutation rates and characteristics for 186 Y-STR markers. Included are mutation rate estimates, most determined for the first time. Also evaluated were the diversity and DNA sequence data generated for all loci to investigate the underlying causes of Y-STR mutability. The suitability of the identified most mutable Y-STRs for male relative differentiation and their implication for Y-chromosome applications in forensic science have been tested and resulted in the identification of 13 rapidly mutating Y-STR (RM-Y-STR) markers.

The 13 Y-STR markers were found to have a mutational rate that is substantially higher than the 173 other Y-STRs tested. These rapidly-mutating markers are DYF387S1, DYF399S1, DYF403S1, DYF404S1, DYS449, DYS518, DYS526, DYS547, DYS570, DYS576, DYS612, DYS626 and DYS627. The mutation rates for these 13 RM-Y-STRs are all well above $10^{-2}$, whereas all other 173 Y-STRs (94% of the loci tested) have mutation rates well below $10^{-2}$ (usually $10^{-3}$ and lower) (FIG. 1). In particular, the locus-specific mutation rates of the 13 RM Y-STRs range from 0.0116 to 0.0744. In comparison, the 17 Y-STRs included in the AmpF/STR® YFiler™ PCR Amplification kit (YFiler Kit, sold by Applied Biosystems/Life Technologies, Foster City, Calif. USA, namely DYS456, DYS389I, DYS390, DYS389II, DYS458, DYS19, DYS385 a/b*, DYS393, DYS391, DYS439, DYS635, DYS392, Y GATA H4, DYS437, DYS438, DYS448) have locus-specific mutation rates ranging from 0.0002 to 0.0065 as established recently based on a large number of >135,000 meiotic transfers (Goedbloed et al. 2009). Hence, Applicants have surprisingly discovered that the 13 RM-Y-STRs mutate 60-11 time more rapidly than YFiler kit Y-STRs that are most commonly used in forensic applications today. The surprisingly high mutation rate in these RM-Y-STR markers permits the increased likelihood of distinguishing between male members of the same paternal genetic lineage. The likelihood of discrimination between members of the same male lineage is even greater when multiple rapidly-mutating Y-STR markers are employed. Various embodiments of the invention provided herein include methods, reagents, and kits for determining the specific allele of one or more, of two or more, of three or more, of four or more, of five or more, and so on, of the subject rapidly-mutating Y-STR markers in a given sample for analysis.

Provided herein are various methods for determining the specific allele of one or more of the rapidly-mutating Y-STR markers. The specific alleles of the rapidly-mutating Y-STR markers can be determined using essentially the same methods and technologies that are used for the determination of alleles other types of STR markers. Such methods and technologies can readily be adapted by the person skilled in the art so as to be suitable for use in the allele determination of the rapidly-mutating Y-STR markers. Examples of such technology include DNA sequencing and sequence specific amplification techniques such as PCR, used in conjunction with detection technologies such as electrophoresis, mass spectroscopy, and the like. In some embodiments, PCR amplification products may be detected by fluorescent dyes conjugated to the PCR amplification primers, for example as described in PCT patent application WO 2009/059049. PCR amplification products can also be detected by other techniques, including, but not limited to, the staining of amplification products, e.g. silver staining and the like.

The specific allele of a given rapidly-mutating Y-STR marker can also be determined by any of a variety of DNA sequencing techniques that are widely available, e.g., Sanger sequencing, pyrosequencing, Maxim and Gilbert sequencing, and the like. Numerous automated DNA sequencing techniques are commercially available, the applied Biosystems 3130, the applied Biosystems 3100, the Illumina Genome Analyzer, the Applied Biosystems SOLiD system, the Roche Genome Sequencer Flx system and the like.

DNA for analysis using the subject methods and compositions can be obtained from a variety of sources. DNA can be obtained at crime scenes, e.g., semen recovered from a rape victim. Additionally, DNA for analysis can be obtained directly from male subjects for the purpose of generating a database of allelic information (for subsequent analysis) or can be obtained from identified suspects.

DNA for analysis can be quantified prior to allelic analysis, thereby providing for more accurate allele calling. DNA quantity in a sample may be determined by many techniques known to the person skilled in the art, e.g., real time PCR. It is of interest to quantify the Y chromosomal DNA present in a sample for analysis prior to performing allelic analysis for Y-chromosomal STR markers, including rapidly-mutating Y-chromosomal STR markers. Autosomal DNA in the sample may also be quantitated, thereby providing a method for determining the background amount of female DNA present in a mixed sample, such as those samples recovered in rape cases.

A Y chromosomal haplotype can be established by determining the specific alleles present on a plurality of Y-STR markers. In general, the more rapidly a Y-STR marker mutates, the greater the probability of being able to distinguish between male relatives based on Y-chromosomal marker analysis. In some embodiments, the rapidly-mutating Y-STR markers can be analyzed by a method employing multiplex PCR. Multiplex PCR can amplify 2, 3, 4, 5, 6, 7, 8, 9, 10, 11, 12 or all 13 of the rapidly-mutating Y-STR markers. In some embodiments, multiplex PCR can co-amplify additional Y-STR markers that are not part of the set of the subject rapidly-mutating Y-STR markers. In some embodiments, a multiplex PCR can provide for the co-amplification of one or more autosomal STR markers, e.g. the CODIS STR markers, D3S1358, vWA, FGA, D8S1179, D21S11, D18551, D5S818, D13S317, D7S820, D16S539, THO1, TPOX, and CSF1PO. Detailed descriptions for the development of multiplex PCR for STR analysis can be found, among other places in PCT patent application WO 2009/059049 A1. In some embodiments the PCR reactions are not multiplexed. The amplicons that are produced in non-multiplex PCR reactions can be combined prior to the analysis of an instrument, e.g. a fluorescent DNA fragment analyzer (such as an automated DNA sequencer) or a mass spectrometer. Mass spectroscopy of STR markers is described in, among other places, U.S. Pat. No. 6,090,558.

Other embodiments include sets of PCR primers for the co-amplification of at least two rapidly-mutating Y-STR markers. Embodiments include sets of PCR primers for the co-amplification of 2, 3, 4, 5, 6, 7, 8, 9, 10, 11, 12 or all 13 of the rapidly-mutating Y-STR markers provided herein. In some embodiments, PCR primer sets can comprise primers for the co-amplification of Y-STR markers that are not rapidly-mutating Y-STR markers. In some embodiments, the set of PCR primers can comprise PCR primers for the co-amplification of STR markers present on an autosome.

The embodiments of the invention also include allelic ladders to aid in the identification of alleles of rapidly-mutating Y-STR markers. The allelic ladders can comprise sets of size standards for 1, 2, 3, 4, 5, 6, 7, 8, 9, 10, 11, 12 or all 13 of the rapidly-mutating Y-STR markers. For each marker present in the allelic ladder, the allelic ladder can comprise standards for one or more alleles. An allelic ladder can comprise size standards for all known alleles of a given rapidly-mutating Y-STR marker, or any subset of known alleles. In some embodiments, the size standards in the allelic ladder can be labeled with one or more fluorescent dyes. In some embodiments an allelic ladder can further comprise size standards for autosomal STR markers. In some embodiments of allelic ladder can further comprise size standards for Y-STR markers that are not rapidly-mutating Y-STR markers.

Other embodiments of the subject invention include kits for the determination of the alleles for two or more rapidly-mutating Y-STR markers. Embodiments of the kits can comprise the subject sets of amplification primers. In some embodiments the kits can comprise one or more reagents used in nucleic amplification reactions. Examples of such reagents include, but are not limited to, DNA polymerases, dNTPs, buffers, nucleic acid purification reagents and the like. In some embodiments, the kits can comprise an allelic ladder designed to act as a size standard for the one or more rapidly-mutating Y-STR marker alleles generated (or potentially generated) by amplification primers present in the kit. Thus, in some embodiments, the kits can comprise allelic ladders specifically adapted to the amplicons generated by the use of the kit primers in an amplification reaction. For example a kit comprising primers for co-amplifying rapidly-mutating Y-STR markers DYF387S1, DYF399S1, and DYF404S1, can also include an allelic ladder having size standards for various alleles of rapidly-mutating Y-STR markers DYF387S1, DYF399S1, and DYF404S1. The kit can contain primers for co-amplifying all 13 RM-Y-STRs as well as an allelic ladder having appropriate size standards as would be known to one of skill in the art. The component size standards of an allelic ladder for given STR marker can be labeled with the same or different detectable labels, e.g., a fluorescent dye, as are the primers used to generate the amplicons of the actual allele in the sample for analysis.

The invention may be better understood by reference to the following examples comprising experimental data. Such information is offered to be examples and is not intended to limit the scope of the claimed invention. Examples and data presented herein were published in K. Ballantyne, et al. "Mutability of Y-Chromosomal Microsatellites: Rates, Characteristics, Molecular Bases and Forensic Implications" Am. J. Hum. Genet. 87:341-353 (Sep. 10, 2010), and published online Sep. 2, 2010, each incorporated by reference herein.

EXAMPLES

DNA Samples

All father-son pairs used in the mutation rate study were confirmed in their paternity by molecular analyses, utilizing autosomal STRs, Y-STRs, HLA and RFLP genotyping and blood grouping, in addition to familial or governmental documentation. A threshold for paternity probability of 99.9% was set for inclusion in the study. Samples were obtained from the Berlin, Leipzig and Cologne areas of Germany, and the Warsaw and Wroclaw areas of Poland. Whole genome amplification using the GenomiPhi DNA Amplification kit (GE Healthcare, Little Chalfont, UK) was performed on the Leipzig samples due to low DNA quantities. WGA reactions were performed as recommended by the manufacturer, and products were purified using Invisorb 96 Filter Microplates (Invitek GmbH, Berlin, Germany). An additional set of independent samples from male relatives not used in the initial mutability screening from male families or pedigrees, used for verifying the value of identified rapidly mutating Y-STRs, came from the Greifswald, Kiel and Berlin areas of Germany, the Leuven area of Belgium, the Warsaw area of Poland, as well as Canada and Central Germany as described elsewhere 12. All families/pedigrees were confirmed by the same methods as the father-son pairs; pairs with complete genotypes for both the rapidly mutating (RM) Y-STRs and Yfiler Y-STRs were considered for analysis, or in the case of partial genotypes only those that showed a mutation at one or more loci were included. The use of all samples for the purpose of this study was in agreement with the institutional regulations and under informed consent.

Y-STR Markers and Genotyping Protocols

Y-STR markers were mostly selected from a previous study detailing a large number of 167 previously unknown Y-STRs 29, with the additional inclusion of Y-STRs known at the time of project commencement 42. The focus was on single-copy Y-STR markers in order to be able to fully confirm genotype differences by DNA sequence analysis when identifying mutations. However, given our aim to find RM Y-STRs, we included some additional multi-copy Y-STRs, especially those with high diversities (for which mutation confirmation was performed by independent genotyping). A complete list of loci, primer sequences and protocols can be found in FIG. 5A-5C. Seventeen of the 186 Y-STRs were genotyped with a commercially available kit, the AmpF/STR Yfiler PCR Amplification kit (Applied Biosystems), following the manufacturer's instructions. Full descriptions of protocols and markers can be found in (28). The remaining 169 Y-STRs were genotyped using 54 multiplex assays including 1 to 5 markers each. PCRs were performed using three differing protocols, and details are provided in FIG. 5A-5C.

In addition, 13 Y-STRs identified during the study as rapidly mutating (RM) Y-STRs were genotyped using three multiplex assays in an independent sample set of male relatives. All PCRs were performed on GeneAmp PCR System 9700 machines (Applied Biosystems) at the Department of Forensic Molecular Biology, Erasmus MC Rotterdam. Fragment length analysis was performed using the 3130xl Genetic Analyzer (Applied Biosystems) at Applied Biosystems, Foster City, USA. Profiles generated were genotyped using GeneMapper software (ID v 3.2, Applied Biosystems). Genotype differences were identified using in-house developed Microsoft Excel 2007 macros. All mutations were confirmed by DNA sequence analysis in Rotterdam of both the father and son at the Y-STR locus, as described in M. Goedbloed, et al. (2009) Int. J. Legal. Med. 123, 471-482. Multi-copy Y-STR loci with three or more alleles were not able to be sequenced, but mutations were confirmed by at least two independent fragment length analysis amplifications.

Statistical Data Analyses

Mutation rates for individual markers were estimated using a binomial hierarchical Bayesian model 43 using the Marcov Chain Monte Carlo (MCMC) Gibbs sampling as implemented in WinBUGS, as described in Goedbloed. In brief, it was assumed that each mutation rate could be considered as a realization of the mutation rate underlying any Y-STR. In brief, we assumed that the mutation rate $\theta i$ of Y-STR i was a sample from a common population distribution defined by hyperparameters $\varphi$. In that way, the estimated mutation rate of a Y-STR incorporates the information provided by the observed data on that Y-STR (number of observed mutations over all the observed father-son pair) and the information of the mutation rate of "the Y-STR" as estimated in the hyperparameter from all the Y-STRs. In practice, this implies that Y-STRs for which no mutation was observed are going to show a mutation rate (estimated from the posterior distribution) which is smaller than other Y-STRs where a large number of mutations are observed, but is always different from 0.

The mutation rate of each Y-STR was coded in a logit form, and assumed to follow a normal distribution with parameters $\mu$ and $\tau=1/\sigma$ to be estimated, as well as the particular mutation rates of each STR. As only very limited data was available prior to our study for the range of Y-STR mutation rates, we assumed diffuse, non-informative prior distributions for the hyperparameters. A non-informative prior normal distribution ($\mu=0$, $\tau=1\times10^{-6}$) was specified for the hyperparameter $\mu$ and a prior diffuse gamma distribution with parameters $\alpha=1\times10^{-5}$ and $\beta=1\times10^{-5}$ for the parameter $\tau$. Three MCMC chains using the Gibbs sampler were generated in parallel when estimating the mutation rate for each locus, with 100,000 runs performed for each chain. Mean, median and 95% credible intervals (CI) were estimated from the three chains after discarding the first 50,000 runs and performing a thinning of 15 in order to reduce the amount of autocorrelation between adjacent simulations. Locus-specific differences in mutation rates between the sampling populations (Cologne, Berlin, Leipzig, Warsaw and Wroclaw) were tested by means of a permutation analysis. The average mutation rate for each locus and each population was compared to a hypothetical permutated population, where each father-son pair had been assigned to a population at random, maintaining the original sample sizes for each locus. The number of times the permutated averaged mutation rate was larger than the observed rate was recorded, and used to obtain the one tail p value over 100,000 iterations. The lack of significant differences between populations allowed pooling of mutation rates across populations.

In order to investigate the mutation rate of the Yfiler and RM Y-STR sets rather than of each marker within the set, the total number of mutations observed between each father-son pair for each set was computed, given the number of Y-STRs analyzed. This parameter was then modeled under the Bayesian paradigm with a Poisson distribution. A prior with a Gamma distribution was used with a diffuse shape of 1 and a scale of 200, implying a mutation rate with a mean of 0.005 and a variance of 40000. The posterior distribution followed a conjugate Gamma distribution with shape of 1+(total number of mutations) and scale of 1/(1/(200+total number of markers used)). In order to estimate the probability of observing at least one mutation in each set, 100000 Monte Carlo replicates were performed with the rgamma function of the R package45 from the estimated shape and scale of the posterior distribution of each set of Y-STRs.

For the RM Y-STR set a median mutation rate of 0.0197 (95% credible interval 0.018-0.022) was estimated that is about 7-fold higher as revealed for the YFiler set consisting of 17 markers with a median rate of 0.0028 (95% credible interval ranging from 0.0023 to 0.0035). Next, the probability of observing at least one mutation per Y-STR set in a given father-son pair, reflecting the minimal criteria for differentiating male relatives, was estimated as 1 minus the probability of observing 0 mutations, which is directly estimated from a Poisson distribution: The probability of observing at least one mutation (k) within either of the YSTR sets in any given father-son pair was directly estimated from the Poisson distribution:

$$P(k>0)=1-P(k=0)=1-e^{-Nm},$$

with N representing the number of markers and m representing the average mutation rate of the set of markers obtained from the sampling from the posterior distribution. Assuming that all Y-STRs per set have been genotyped successfully, and using the posterior estimates of the mutation rate for each set of markers, the probability of observing at least one mutation with the RM Y-STR set is 0.1952 (95% credible interval of 0.177 to 0.21). This value is more than four times higher than that estimated for the YFiler set with 0.047 (95% credible interval of 0.038 to 0.057), although six more markers are included in the YFiler set relative to the RM Y-STR set. The molecular factors determining mutation rates were modeled using a Poisson regression with in-house developed Matlab scripts (v7.6.0.324, The Mathworks, Inc., Natick, Mass., USA). The mutation rate was modeled as a function dependent on of the repeat length, the sequence motif, the complexity of the locus and the length of the repeat in base pairs (tri-, tetra-, penta- or hexanucleotide), as:

$$p(y\mid\theta)=\prod_{i=1}^{n}\frac{1}{y_1!}(x_i\theta)^{y_1}e^{-x_i\theta}$$

where $\theta$ is assumed to be dependent on the factors described above, in the form $$\theta=e^{\alpha L+\beta S+\gamma C+\sigma V+\varepsilon R+\zeta N}$$

where L represents the length of the allele (number or repeats, either of the longest homogenous array or the total locus), S represents the sequence motif (comprised of the number of A,T,C or G nucleotides in the repeated sequence motif), C represents the complexity of the locus, either in binary or quantitative form, V is the number of variable motifs present, R is the repeat length, and N is the copy number of the locus. A stepwise regression procedure was used, with probability to enter ≤0.05, probability to remove ≥0.10. For clarity, the methods used for defining and calculating the number of repeats within a locus, and the complexity of that locus, are elucidated below.

Locus designations were modeled after Kayser et al., where at least 3 consecutive repeats of the same motif are required to define a given repeat segment as a locus, and any interruption of more than 1 base, but less than a full unit, is classed as ending the locus. Individual Y-STR loci contained between 1 and 5 repeat blocks, as in, for example, DYS612 with 5 blocks (CCT)5(CTT)1(TCT)4(CCT)1(TCT)19 (SEQ ID NO: 2197). If a locus contained more than one variable segment, and repeat numbers could not be assigned to all individuals at all repeat segments accurately, the locus was removed from the regression analysis. A segment was defined as variable if a variation in repeat number was seen in any individual sequenced, relative to the remainder of the population.

Number of repeats: The number of repeats in the longest homogenous array was directly counted, and the population average calculated for each locus. In addition, any additional repeats around the longest array were added to calculate the total number of repeats for each locus. In the above example for DYS612, the length of the longest array is 19, while the total number of repeats is 30.

Repeat Length: The length in base pairs of the repetitive motif, which ranged from 3 to 6 (included tri-, tetra-, penta-, hexa- and heptanucleotide repeats).

Complexity: Two complexity statistics were calculated per locus. First, a binary classification system was used, where loci with only one repetitive segment (e.g. (GATA)10 (SEQ ID NO: 2198)) were classified as simple, while any locus with two or more repetitive segments consisting of more than three consecutive repeats (e.g. (GATA)10 (CATA)3 (SEQ ID NO: 2199)) was complex. Second, more quantitative information was provided by Kayser et al.'s complexity formula:

$$C = \frac{n^2}{(n-1)^2}\left(1 - \sum_{i=1}^{m}\left(\frac{s_i}{n}\right)^2\right)\left(1 - \sum_{i=1}^{l}\left(\frac{b_i}{n}\right)^2\right)$$

where n is the total number of repeats in the locus, $s_i$ is the number of repeats of the ith sequence motif, and bi is the number of repeats in the ith block. Correlation and log linear regression analyses were carried out in SPSS v15.0 (SPSS Inc.), as were all mean comparison tests (utilizing ANOVA, Mann-Whitney U and Kruskal Wallis).

Repeat Length: The length in base pairs of the repetitive motif, which ranged from 3 to 6 (included tri-, tetra-, penta-, hexa- and heptanucleotide repeats).

Mutation Rates of Y-STR Markers

In order to define the expectation for a given RM Y-STR set to differentiate between male relatives, and to compare such potential with that of the commonly-used YFiler set, an average mutation rate for each of the two Y-STR sets applying a Bayesian approach was obtained. The number of mutations observed in one father-son pair for a set of STRs was modeled by means of a Poisson distribution. A prior conjugate Gamma distribution with a diffuse shape of 1 and a scale of 1/0.005 was used. The posterior distribution followed a Gamma distribution with shape of 1+total number of mutations and scale of 1/(1/0.005+total number of markers used) was obtained and 100000 Monte Carlo replicates were performed.

Furthermore, to test in independent samples whether the new RM Y-STR set is practical and useful for differentiating male relatives, genotyping was performed on both marker sets in 107 pairs from 80 male pedigrees who were related by between 1 and 20 generations within their pedigrees and compared the findings with those from YFiler also generated. Pedigrees came from the Greifswald and Kiel (N. von Wurmb-Schwark, V. Mályusz, E. Simeoni, E. Lignitz, M. Poetsch, For. Sci. Int. 159, 92-97 (2006)), as well as Berlin (new to this study) areas of Germany, the Leuven area of Belgium (new to this study), the Warsaw area of Poland (new to this study), as well as from Canada C. Moreau, H. Vézina, V. Yotova, R. Hamon, P. de Kniff et al., Am. J. Phys. Anthropol. 139, 512-522 (2009), M. Vermeulen, A. Wollstein, K. van der Gaag, O. Lao, Y. Xue et al., For. Sci. Int. Genet., 3, 205-213 (2009) and Central Germany M. Kayser, M. Vermeulen, H. Knoblauch, H. Schuster, M. Krawczak, L. Roewer, For. Sci. Int. Genet. 1, 125-128 (2007)), as described elsewhere. All pedigrees were confirmed by DNA data (including autosomal STR, HLA and RFLP typing, Y-STR and Y-SNP typing, and mtDNA sequencing amongst various pedigrees), as well as additionally by familial or governmental documentation records. Only pairs which had complete genotypes for both sets, or in the case of partial genotypes, showed a mutation at one or more loci, were included in the calculations. Results are provided in FIG. 2. The RM Y-STR set distinguished over 65% of pairs by at least 1 mutation, reflecting a 5-fold increase in the level of male relative differentiation compared to the YFiler set with only 13%, similar to our statistical expectations from the initial father-son pair analyses. Within the pedigrees, the RM Y-STR set distinguished 60% of father-son pairs, 54% of brothers, and 87% of second cousins. If relatives were separated by more than 11 meioses, 100% of individuals were separated by 1 or more mutations using the RM Y-STR set. In contrast, the Y-filer set distinguished in this dataset no father son pairs, no second cousins, and only 6% of brothers in this dataset.

186 tri-, tetra- penta- and hexanucleotide Y-STR markers were screened for mutations in up to 1966 DNA-confirmed father-son pairs per marker by multiplex fluorescence-based fragment length analysis, giving direct observation of 352, 999 meiotic transfers (for technical details see FIGS. 5A-5C). To confirm mutations, all Y-STR genotype differences observed between fathers and their sons were confirmed by DNA sequence analysis for single copy and duplicated markers, or by duplicate fragment length genotyping analysis for multi-copy Y-STRs with more than 2 copies (where sequence analysis was not informative). Overall, we identified 924 confirmed mutations at 120 (64.5%) of the 186 Y-STR markers studied (details of each mutation observed can be found in FIG. 6).

For 66 Y-STR markers, the up to 1966 father-son pairs analyzed did not allow us to detect mutations due to a very low underlying mutation rate. The large number of Y-STR markers employed identified the range of Bayesian-based mutation rates estimated from the median of the posterior distribution to be between $3.81 \times 10^{-4}$ (95% CI $1.38 \times 10^{-5}$ to $2.02 \times 10^{-3}$) and $7.73 \times 10^{-2}$ ($6.51 \times 10^{-2}$ to $9.09 \times 10^{-2}$) per marker, per generation (FIG. 1 and FIGS. 5A-5C). Ninety-one Y-STR markers (48.9%) had mutation rates in the order of 10-3, a further 82 markers (44%) in the order of 10-4, and 13 (6.9%) in the order of 10-2. Across all 186 Y-STR markers, the average mutation rate was $3.35 \times 10^{-3}$ (95% CI 1.79×10⁻³ to 6.38×10⁻³) with an average rate of $4.26 \times 10^{-3}$ (95% CI $2.38 \times 10^{-3}$ to $7.60 \times 10^{-3}$) for the 122 tetranucleotide repeats as the largest repeat-length subgroup of Y-STR markers included here. Notably, the 13 Y-STR markers with mutation rates above $1 \times 10^{-2}$ representing only 7% of the markers studied, which we termed "Rapidly mutating Y-STRs" (RM Y-STRs), covered a large number of 462 of the 924 (50%) mutations observed in the study.

Number of repeats. Two estimates of the average number of repeats were calculated for each Y-STR locus i) the average repeat number in the longest homogenous array; and ii) the repeat number of the longest homogeneous array plus any non-variable repeats immediately adjacent (in accordance with previously defined rules for motif structure 29). Our regression analysis showed that while the number of repeats in the longest homogenous array did influence the mutation rate significantly, with higher numbers of repeats increasing the mutation rate (Wald $\chi^2=2.41 \times 10^6$, p<0.0001), including the number of non-variable repeats surrounding the array provided slightly more accurate information to the model (Wald $\chi^2=3.03 \times 10^6$, p<0.0001, FIG. 2). The effect size within the model was estimated with a partial $\eta^2$ of 0.798, indicating that the variance in the total number of repeats between loci accounts for ~78% of the overall (effect+error) variation in Y-STR mutation rates observed. In addition, a statistically significant exponential relationship was observed between the total number of repeats and the allele-specific mutation rate ($R^2=0.707$, $p=6.84 \times 10^{-9}$). In addition, there was a strong relationship between the total number of repeats and the direction of mutation (FIG. 3). Longer alleles displayed an exponential and statistically significant tendency towards repeat losses (contractions) ($R^2=0.585$, $p=8.27 \times 10^{-7}$), while shorter alleles gained repeats (expansion) significantly more frequently ($R^2=0.238$, $p=0.011$). The expansion mutation rate had a quadratic distribution, with a vertex around 19 repeats.

Male Relative Differentiation by RM Y-STRs

We identified 13 rapidly-mutating (RM) Y-STR markers (all with mutation rates >$1 \times 10^{-2}$); DYF387S1, DYF399S1, DYF403S1, DYF404S1, DYS449, DYS518, DYS526, DYS547, DYS570, DYS576, DYS612, DYS626 and DYS627 (FIG. 1 and FIG. 5A-5C). Four of these 13 RM Y-STR markers are multi-copy systems (DYF387S1 with two, DYF399S1 with three, DYF403S1 with four, DYF404S1 with two and DYS526 with two copies), whereas nine were single-copy Y-STR markers (although six of these markers contained multiple Y-STR loci within the single amplicon, and only two, DYS570 and DYS576, were simple repeats with only one Y-STR locus respectively). The 13 RM Y-STRs were combined into a set under the hypothesis that closely related males (even father-son or brother pairs) may be differentiable by Y-STR mutations if RM Y-STRs are combined. In principle, one mutation at one of the 13 RM Y-STRs would be enough for individual differentiation.

In order to define a statistical expectation for the RM Y-STR set to differentiate between male relatives, and to compare their potential with that of the commonly used Yfiler set, we first computed the mutation rate observed for each of the two Y-STR sets by means of a Bayesian approach. The number of mutations observed in each father-son pair for each set of Y-STRs was modeled by means of a Poisson distribution. For the RM Y-STRs a median mutation rate of $1.97 \times 10^{-2}$ (95% CI $1.8 \times 10^{-2}$-$2.2 \times 10^{-2}$) of the posterior distribution was estimated, which was 6.5-fold higher than that estimated for Yfiler Y-STRs with a median rate of $3.0 \times 10^{-3}$ (95% CI ranging from $2.39 \times 10^{-3}$ to $3.72 \times 10^{-3}$). Next, the probability of observing at least one mutation in each of the two Y-STR sets for a given father-son pair was estimated, reflecting the minimal criteria for differentiating male relatives. Assuming that all Y-STRs per set were genotyped successfully, and using the posterior estimates of the mutation rate for each set of Y-STR markers, the probability of observing at least one mutation with the RM Y-STR set was 0.1952 (95% CI of 0.177 to 0.21). This value was surprisingly more than four times higher than that estimated for the Yfiler set with 0.047 (95% CI of 0.038 to 0.057). The probability of observing at least one mutation with the RM Y-STR set was statistically significantly higher than for the Yfiler set ($p<5.0 \times 10^{-07}$). Finally, samples were empirically tested independent of those samples used for mutation rate establishment whether the new RM Y-STR set is practically useful for differentiating male relatives. For this, 103 male relative pairs from 80 male pedigrees who were related by between 1 and 20 generations within their pedigrees were genotyped and compared with the findings with those obtained from Yfiler kit in the same samples. Overall, the RM Y-STR set distinguished 70.9% pairs of male relatives by at least 1 mutation, reflecting a 5-fold increase in the level of male relative differentiation compared to the Yfiler kit set with only 13%; notably, the significant difference (t=6.389, p<0.0001) is similar to statistical expectations from the initial father-son pair analyses (FIG. 4 and FIG. 7). Within the pedigrees, the RM Y-STR set distinguished 70% of father-son pairs, 56% of brothers, and 67% of cousins (FIG. 4 and FIG. 7). In contrast, the Yfiler set was not able to differentiate any of the father-son pairs nor cousins, and only 6% of the brothers in this dataset (FIG. 4 and FIG. 7). Furthermore, all relatives separated by more than 11 generations were differentiable by 1 or more mutations using the RM Y-STR set, but only 33% with the Yfiler set.

All of the compositions and methods disclosed and claimed herein can be made and executed without undue experimentation in light of the present disclosure. While the compositions and methods of this invention may have been described in terms of specific examples or preferred embodiments, these examples and embodiments are in no way intended to limit the scope of the claims, and it will be apparent to those of skill in the art that variations may be applied to the compositions and/or methods and in the steps or in the sequence of steps of the methods described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

SEQUENCE LISTING (2199 sequences)

SEQ ID NO: 1 - DNA, 33 bp, Homo sapiens
  misc_feature (1)..(33): This sequence may encompass 8-11 "aat" repeating units
aataataataataataataataataataataat

SEQ ID NO: 2 - DNA, 24 bp, Homo sapiens
  misc_feature (1)..(24): This sequence may encompass 7-8 "ttg" repeating units
ttgttgttgttgttgttgttgttg

SEQ ID NO: 3 - DNA, 24 bp, Homo sapiens
  misc_feature (1)..(24): This sequence may encompass 7-8 "aac" repeating units
aacaacaacaacaacaacaacaac

SEQ ID NO: 4 - DNA, 100 bp, Homo sapiens
  misc_feature (1)..(64): This region may encompass 9-16 "ggat" repeating units
  modified_base (81)..(88): a, c, t, g, unknown or other
ggatggatggatggatggatggatggatggatggatggatggatggatggatggatggatggatagatggatggatggatnnnnnnnnggacggacggac

SEQ ID NO: 5 - DNA, 48 bp, Homo sapiens
  misc_feature (1)..(48): This sequence may encompass 7-16 "aat" repeating units
aataataataataataataataataataataataataataataataat

SEQ ID NO: 6 - DNA, 136 bp, Homo sapiens
  modified_base (33)..(48): a, c, t, g, unknown or other
aaagaaagaaaggtaggaaggaaggaaggaagnnnnnnnnnnnnnnnngaaggaaggaaggaaggaaggaaggaaggaaggaagaaagaaagaaagaaagaaagaaagaaagaaagaaagaaagaaagaaagaaag

SEQ ID NO: 7 - DNA, 210 bp, Homo sapiens
  misc_feature (25)..(100): This region may encompass 5-19 "cttt" repeating units
  modified_base (101)..(118): a, c, t, g, unknown or other
  modified_base (147)..(154): a, c, t, g, unknown or other
  modified_base (167)..(198): a, c, t, g, unknown or other
cttccttccttccttccttccttcctttctttctttctttctttctttctttctttctttctttctttctttctttctttctttctttctttctttctttnnnnnnnnnnnnnnnnnncttccttccttctttccttccttccttcnnnnnnnncttccttccttcnnnnnnnnnnnnnnnnnnnnnnnnnnnnnnnncttccttccttc

SEQ ID NO: 8 - DNA, 56 bp, Homo sapiens
  misc_feature (1)..(56): This sequence may encompass 9-14 "ttta" repeating units
tttatttatttatttatttatttatttatttatttatttatttatttatttattta

SEQ ID NO: 9 - DNA, 110 bp, Homo sapiens
  misc_feature (15)..(104): This region may encompass 16-30 "aag" repeating units
  misc_feature (105)..(110): This region may encompass 1-2 "cag" repeating units
aagaagaagaagaaaagaagaagaagaagaagaagaagaagaagaagaagaagaagaagaagaagaagaagaagaagaagaagaagaagaagaagaagaagaagcagcag

SEQ ID NO: 10 - DNA, 39 bp, Homo sapiens
  misc_feature (13)..(39): This region may encompass 6-9 "att" repeating units
attattattgttattattattattattattattattatt

SEQ ID NO: 11 - DNA, 27 bp, Homo sapiens
  misc_feature (1)..(27): This sequence may encompass 6-9 "tct" repeating units
tcttcttcttcttcttcttcttcttct

SEQ ID NO: 12 - DNA, 112 bp, Homo sapiens
  misc_feature (13)..(20): This region may encompass 7-8 "n" repeating units
  modified_base (13)..(20): a, c, t, g, unknown or other
  misc_feature (21)..(112): This region may encompass 10-23 "gaaa" repeating units
gaaagaaagaaannnnnnnngaaagaaagaaagaaagaaagaaagaaagaaagaaagaaagaaagaaagaaagaaagaaagaaagaaagaaagaaagaaagaaagaaagaaa

SEQ ID NO: 13 - DNA, 245 bp, Homo sapiens
  modified_base (29)..(67): a, c, t, g, unknown or other
  modified_base (80)..(87): a, c, t, g, unknown or other
  modified_base (116)..(128): a, c, t, g, unknown or other
  misc_feature (129)..(220): This region may encompass 8-23 "aaag" repeating units
aaggaaggaaggaagcaaggaaggaaggnnnnnnnnnnnnnnnnnnnnnnnnnnnnnnnnnnnnnnnaaggaaggaaggnnnnnnnnaaggaaggaaggaaagaaggaaggaaggnnnnnnnnnnnnnaaagaaagaaagaaagaaagaaagaaagaaagaaagaaagaaagaaagaaagaaagaaagaaagaaagaaagaaagaaagaaagaaagaaaggaaggaaggaaggaaggaaggaagg

SEQ ID NO: 14 - DNA, 139 bp, Homo sapiens
  misc_feature (1)..(68): This region may encompass 10-17 "ttct" repeating units
  misc_feature (69)..(71): This region may encompass 2-3 "n" repeating units
  modified_base (69)..(71): a, c, t, g, unknown or other
  misc_feature (72)..(139): This region may encompass 3-17 "ttct" repeating units
ttctttctttctttctttctttctttctttctttctttctttctttctttctttctttctttctttctnnnttctttctttctttctttctttctttctttctttctttctttctttctttctttctttctttctttct

SEQ ID NO: 15 - DNA, 188 bp, Homo sapiens
  modified_base (49)..(50): a, c, t, g, unknown or other
  modified_base (175)..(176): a, c, t, g, unknown or other
ttctttctttctttctttctttctttctttctttctttctttctttctnnttctttctttctttctttctttctttctttctttccttccttccttccttccttccttccttccttccttctttctttctttctttctttctttctttctttctttctttctttctttctttctnnttctttctttct

SEQ ID NO: 16 - DNA, 134 bp, Homo sapiens
  misc_feature (1)..(80): This region may encompass 10-20 "tttc" repeating units
  modified_base (81)..(122): a, c, t, g, unknown or other
tttctttctttctttctttctttctttctttctttctttctttctttctttctttctttctttctttctttctttctttcnnnnnnnnnnnnnnnnnnnnnnnnnnnnnnnnnnnnnnnnnntttctttctttc

SEQ ID NO: 17 - DNA, 199 bp, Homo sapiens
  misc_feature (1)..(56): This region may encompass 4-14 "ggaa" repeating units
  modified_base (57)..(171): a, c, t, g, unknown or other
ggaaggaaggaaggaaggaaggaaggaaggaaggaaggaaggaaggaaggaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggaaggaagaaaggaaggaaggaa

SEQ ID NO: 18 - DNA, 56 bp, Homo sapiens
  misc_feature (1)..(56): This sequence may encompass 8-14 "tatc" repeating units
tatctatctatctatctatctatctatctatctatctatctatctatctatctatc

SEQ ID NO: 19 - DNA, 52 bp, Homo sapiens
  misc_feature (1)..(52): This sequence may encompass 7-13 "aaat" repeating units
aaataaataaataaataaataaataaataaataaataaataaataaataaat

SEQ ID NO: 20 - DNA, 80 bp, Homo sapiens
  misc_feature (17)..(80): This region may encompass 6-16 "taga" repeating units
tagatagatagataggtagatagatagatagatagatagatagatagatagatagatagatagatagatagatagataga

SEQ ID NO: 21 - DNA, 215 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
  misc_feature (96)..(123): This region may encompass 6-7 "aagg" repeating units
  misc_feature (124)..(215): This region may encompass 7-23 "gaaa" repeating units
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaaggaagggaaagaaagaaagaaagaaagaaagaaagaaagaaagaaagaaagaaagaaagaaagaaagaaagaaagaaagaaagaaagaaagaaagaaa

SEQ ID NO: 22 - DNA, 215 bp, Homo sapiens; identical to SEQ ID NO: 21
  modified_base (17)..(30): a, c, t, g, unknown or other
  modified_base (43)..(54): a, c, t, g, unknown or other
  modified_base (67)..(95): a, c, t, g, unknown or other
  misc_feature (96)..(123): This region may encompass 6-7 "aagg" repeating units
  misc_feature (124)..(215): This region may encompass 7-23 "gaaa" repeating units

SEQ ID NO: 23 - DNA, 54 bp, Homo sapiens
  misc_feature (1)..(54): This sequence may encompass 9-18 "att" repeating units
attattattattattattattattattattattattattattattattattatt

SEQ ID NO: 24 - DNA, 68 bp, Homo sapiens
  misc_feature (13)..(68): This region may encompass 6-14 "tcta" repeating units
tctgtctgtctgtctatctatctatctatctatctatctatctatctatctatctatctatctatcta

SEQ ID NO: 25 - DNA, 172 bp, Homo sapiens
  misc_feature (1)..(20): This region may encompass 4-5 "tctg" repeating units
  misc_feature (21)..(76): This region may encompass 10-14 "tcta" repeating units
  modified_base (77)..(104): a, c, t, g, unknown or other
  misc_feature (117)..(172): This region may encompass 6-14 "tcta" repeating units
tctgtctgtctgtctgtctgtctatctatctatctatctatctatctatctatctatctatctatctatctatctannnnnnnnnnnnnnnnnnnnnnnnnnnntctgtctgtctgtctatctatctatctatctatctatctatctatctatctatctatctatctatcta

SEQ ID NO: 26 - DNA, 108 bp, Homo sapiens
  misc_feature (33)..(88): This region may encompass 9-14 "tcta" repeating units
tctgtctgtctgtctgtctgtctgtctgtctgtctatctatctatctatctatctatctatctatctatctatctatctatctatctatctgtctgtctgtctgtctg

SEQ ID NO: 27 - DNA, 72 bp, Homo sapiens
  misc_feature (13)..(72): This region may encompass 6-15 "tcta" repeating units
tctgtctgtctgtctatctatctatctatctatctatctatctatctatctatctatctatctatctatcta

SEQ ID NO: 28 - DNA, 60 bp, Homo sapiens
  misc_feature (1)..(60): This sequence may encompass 4-20 "tat" repeating units
tattattattattattattattattattattattattattattattattattattattat

SEQ ID NO: 29 - DNA, 72 bp, Homo sapiens
  misc_feature (1)..(72): This sequence may encompass 7-18 "agat" repeating units
agatagatagatagatagatagatagatagatagatagatagatagatagatagatagatagatagatagat

SEQ ID NO: 30 - DNA, 42 bp, Homo sapiens
  misc_feature (1)..(42): This sequence may encompass 8-14 "tgt" repeating units
tgttgttgttgttgttgttgttgttgttgttgttgttgttgt

SEQ ID NO: 31 - DNA, 36 bp, Homo sapiens
  misc_feature (1)..(36): This sequence may encompass 9-12 "gtt" repeating units
gttgttgttgttgttgttgttgttgttgttgttgtt

SEQ ID NO: 32 - DNA, 48 bp, Homo sapiens
  misc_feature (1)..(48): This sequence may encompass 9-12 "atct" repeating units
atctatctatctatctatctatctatctatctatctatctatctatct

SEQ ID NO: 33 - DNA, 48 bp, Homo sapiens
  misc_feature (1)..(48): This sequence may encompass 10-12 "tgga" repeating units
tggatggatggatggatggatggatggatggatggatggatggatgga

SEQ ID NO: 34 - DNA, 39 bp, Homo sapiens
  misc_feature (1)..(39): This sequence may encompass 11-13 "gtt" repeating units
gttgttgttgttgttgttgttgttgttgttgttgttgtt

SEQ ID NO: 35 - DNA, 72 bp, Homo sapiens
  misc_feature (1)..(48): This region may encompass 4-12 "tcta" repeating units
tctatctatctatctatctatctatctatctatctatctatctatctatctgtctgtctatctatctatcta

SEQ ID NO: 36 - DNA, 80 bp, Homo sapiens
  misc_feature (1)..(80): This sequence may encompass 7-16 "ttttc" repeating units
ttttcttttcttttcttttcttttcttttcttttcttttcttttcttttcttttcttttcttttcttttcttttcttttc

SEQ ID NO: 37 - DNA, 120 bp, Homo sapiens
  modified_base (13)..(44): a, c, t, g, unknown or other
  misc_feature (45)..(120): This region may encompass 5-19 "gata" repeating units
gatagatagatannnnnnnnnnnnnnnnnnnnnnnnnnnnnnnngatagatagatagatagatagatagatagatagatagatagatagatagatagatagatagatagatagatagata

SEQ ID NO: 38 - DNA, 88 bp, Homo sapiens
  misc_feature (1)..(88): This sequence may encompass 12-22 "ttcc" repeating units
  See specification as filed for detailed description of substitutions and preferred embodiments
ttccttccttccttccttccttccttccttccttccttccttccttccttccttccttccttccttccttccttccttccttccttcc

SEQ ID NO: 39 - DNA, 76 bp, Homo sapiens
  misc_feature (1)..(64): This region may encompass 9-16 "gata" repeating units
gatagatagatagatagatagatagatagatagatagatagatagatagatagatagatagatagacagacagaca

SEQ ID NO: 40 - DNA, 77 bp, Homo sapiens
  misc_feature (1)..(68): This region may encompass 11-17 "ttcc" repeating units
ttccttccttccttccttccttccttccttccttccttccttccttccttccttccttccttccttcccttcttctt

SEQ ID NO: 41 - DNA, 64 bp, Homo sapiens
  misc_feature (1)..(64): This sequence may encompass 9-16 "taga" repeating units
tagatagatagatagatagatagatagatagatagatagatagatagatagatagatagataga

SEQ ID NO: 42 - DNA, 56 bp, Homo sapiens; identical to SEQ ID NO: 8
  misc_feature (1)..(56): This sequence may encompass 6-14 "ttta" repeating units

SEQ ID NO: 43 - DNA, 105 bp, Homo sapiens
  misc_feature (1)..(105): This sequence may encompass 8-21 "tctct" repeating units
tctcttctcttctcttctcttctcttctcttctcttctcttctcttctcttctcttctcttctcttctcttctcttctcttctcttctcttctcttctcttctct

SEQ ID NO: 44 - DNA, 155 bp, Homo sapiens
  misc_feature (1)..(35): This region may encompass 6-7 "ttata" repeating units
  misc_feature (41)..(105): This region may encompass 8-13 "ttata" repeating units
  misc_feature (111)..(155): This region may encompass 5-9 "ttata" repeating units
ttatattatattatattatattatattatattatattattttatattatattatattatattatattatattatattatattatattatattatattatattatattattttatattatattatattatattatattatattatattatattata

SEQ ID NO: 45 - DNA, 174 bp, Homo sapiens
  misc_feature (1)..(78): This region may encompass 11-13 "agagat" repeating units
  modified_base (79)..(120): a, c, t, g, unknown or other
  misc_feature (121)..(174): This region may encompass 8-9 "agagat" repeating units
agagatagagatagagatagagatagagatagagatagagatagagatagagatagagatagagatagagatagagatnnnnnnnnnnnnnnnnnnnnnnnnnnnnnnnnnnnnnnnnnnagagatagagatagagatagagatagagatagagatagagatagagatagagat

SEQ ID NO: 46 - DNA, 198 bp, Homo sapiens
  misc_feature (1)..(76): This region may encompass 13-19 "ttct" repeating units
  modified_base (77)..(98): a, c, t, g, unknown or other
  modified_base (111)..(122): a, c, t, g, unknown or other
  misc_feature (123)..(198): This region may encompass 13-19 "ttct" repeating units
ttctttctttctttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttctttctttct

SEQ ID NO: 47 - DNA, 82 bp, Homo sapiens
  misc_feature (1)..(55): This region may encompass 7-11 "tttta" repeating units
  modified_base (56)..(67): a, c, t, g, unknown or other
ttttattttattttattttattttattttattttattttattttattttattttannnnnnnnnnnnttttattttatttta

SEQ ID NO: 48 - DNA, 165 bp, Homo sapiens
  misc_feature (1)..(70): This region may encompass 5-14 "tatac" repeating units
  misc_feature (71)..(110): This region may encompass 2-4 "catactatac" repeating units
  modified_base (111)..(130): a, c, t, g, unknown or other
tatactatactatactatactatactatactatactatactatactatactatactatactatactataccatactataccatactataccatactataccatactatacnnnnnnnnnnnnnnnnnnnntatactatactataccatactatactatactatac

SEQ ID NO: 49 - DNA, 60 bp, Homo sapiens
  misc_feature (1)..(60): This sequence may encompass 9-15 "aaat" repeating units
aaataaataaataaataaataaataaataaataaataaataaataaataaataaataaat

SEQ ID NO: 50 - DNA, 52 bp, Homo sapiens; identical to SEQ ID NO: 19
  misc_feature (1)..(52): This sequence may encompass 7-13 "aaat" repeating units

SEQ ID NO: 51 - DNA, 44 bp, Homo sapiens
  misc_feature (1)..(44): This sequence may encompass 6-11 "attt" repeating units
  See specification as filed for detailed description of substitutions and preferred embodiments
atttatttatttatttatttatttatttatttatttatttattt

SEQ ID NO: 52 - DNA, 92 bp, Homo sapiens
  misc_feature (1)..(92): This sequence may encompass 11-23 "agat" repeating units
agatagatagatagatagatagatagatagatagatagatagatagatagatagatagatagatagatagatagatagatagatagatagat

SEQ ID NO: 53 - DNA, 96 bp, Homo sapiens
  misc_feature (1)..(96): This sequence may encompass 11-24 "gaaa" repeating units
gaaagaaagaaagaaagaaagaaagaaagaaagaaagaaagaaagaaagaaagaaagaaagaaagaaagaaagaaagaaagaaagaaagaaagaaa

SEQ ID NO: 54 - DNA, 44 bp, Homo sapiens; identical to SEQ ID NO: 51
  misc_feature (1)..(44): This sequence may encompass 6-11 "attt" repeating units

SEQ ID NO: 55 - DNA, 52 bp, Homo sapiens
  misc_feature (1)..(52): This sequence may encompass 8-13 "taga" repeating units
tagatagatagatagatagatagatagatagatagatagatagatagataga

SEQ ID NO: 56 - DNA, 52 bp, Homo sapiens; identical to SEQ ID NO: 55
  misc_feature (1)..(52): This sequence may encompass 8-13 "taga" repeating units

SEQ ID NO: 57 - DNA, 56 bp, Homo sapiens
  misc_feature (1)..(56): This sequence may encompass 9-14 "cata" repeating units
catacatacatacatacatacatacatacatacatacatacatacatacatacata

SEQ ID NO: 58 - DNA, 130 bp, Homo sapiens
  misc_feature (1)..(35): This region may encompass 6-7 "aaagg" repeating units
  misc_feature (36)..(130): This region may encompass 9-19 "aaggg" repeating units
aaaggaaaggaaaggaaaggaaaggaaaggaaaggaagggaagggaagggaagggaagggaagggaagggaagggaagggaagggaagggaagggaagggaagggaagggaagggaagggaagggaaggg

SEQ ID NO: 59 - DNA, 162 bp, Homo sapiens
  misc_feature (1)..(80): This region may encompass 9-20 "cctt" repeating units
  modified_base (81)..(126): a, c, t, g, unknown or other
  modified_base (139)..(146): a, c, t, g, unknown or other
ccttccttccttccttccttccttccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 60 - DNA, 268 bp, Homo sapiens
  modified_base (13)..(56): a, c, t, g, unknown or other
  modified_base (66)..(105): a, c, t, g, unknown or other
  modified_base (115)..(149): a, c, t, g, unknown or other
  modified_base (162)..(169): a, c, t, g, unknown or other
  misc_feature (182)..(208): This region may encompass 7-9 "ctt" repeating units
  misc_feature (209)..(268): This region may encompass 8-10 "attcat" repeating units
ctgctgctgctgnnnnnnnnnnnnnnnnnnnnnnnnnnnnnnnnnnnnnnnnnnnncctcctcctnnnnnnnnnnnnnnnnnnnnnnnnnnnnnnnnnnnnnnnncttcttcttnnnnnnnnnnnnnnnnnnnnnnnnnnnnnnnnnnncctcctcctcctnnnnnnnnctcctcctcctccttcttcttcttcttcttcttcttcttattcatattcatattcatattcatattcatattcatattcatattcatattcatattcat

SEQ ID NO: 61 - DNA, 352 bp, Homo sapiens
  modified_base (10)..(48): a, c, t, g, unknown or other
  misc_feature (64)..(153): This region may encompass 10-30 "ctt" repeating units
  modified_base (164)..(180): a, c, t, g, unknown or other
  modified_base (196)..(232): a, c, t, g, unknown or other
  modified_base (242)..(253): a, c, t, g, unknown or other
  modified_base (266)..(277): a, c, t, g, unknown or other
  modified_base (287)..(298): a, c, t, g, unknown or other
  modified_base (326)..(334): a, c, t, g, unknown or other
cttcttcttnnnnnnnnnnnnnnnnnnnnnnnnnnnnnnnnnnnnnnncttcttcttcttgttcttcttcttcttcttcttcttcttcttcttcttcttcttcttcttcttcttcttcttcttcttcttcttcttcttcttcttcttcttctttcttcttcttnnnnnnnnnnnnnnnnncttcttcttcttcttnnnnnnnnnnnnnnnnnnnnnnnnnnnnnnnnnnnnncttcttcttnnnnnnnnnnnncttcttcttcttnnnnnnnnnnnncttcttcttnnnnnnnnnnnncttcttcttcttcttcctcctcctcctnnnnnnnnncttcttcttcctcctcct

SEQ ID NO: 62 - DNA, 78 bp, Homo sapiens
  misc_feature (1)..(36): This region may encompass 8-12 "gtt" repeating units
  modified_base (37)..(69): a, c, t, g, unknown or other
gttgttgttgttgttgttgttgttgttgttgttgttnnnnnnnnnnnnnnnnnnnnnnnnnnnnnnnnngttgttgtt

SEQ ID NO: 63 - DNA, 27 bp, Homo sapiens
  misc_feature (1)..(27): This sequence may encompass 7-9 "aat" repeating units
aataataataataataataataataat

SEQ ID NO: 64 - DNA, 75 bp, Homo sapiens
  modified_base (25)..(36): a, c, t, g, unknown or other
  misc_feature (37)..(75): This region may encompass 9-13 "aat" repeating units
aataataataataataataataatnnnnnnnnnnnnaataataataataataataataataataataataataat

SEQ ID NO: 65 - DNA, 30 bp, Homo sapiens
  misc_feature (1)..(30): This sequence may encompass 9-10 "aac" repeating units
aacaacaacaacaacaacaacaacaacaac

SEQ ID NO: 66 - DNA, 39 bp, Homo sapiens
  misc_feature (1)..(27): This region may encompass 7-9 "taa" repeating units
taataataataataataataataataacaataataataa

SEQ ID NO: 67 - DNA, 39 bp, Homo sapiens
  misc_feature (1)..(39): This sequence may encompass 7-13 "tga" repeating units
tgatgatgatgatgatgatgatgatgatgatgatgatga

SEQ ID NO: 68 - DNA, 27 bp, Homo sapiens
  misc_feature (1)..(27): This sequence may encompass 8-9 "ttg" repeating units
ttgttgttgttgttgttgttgttgttg

SEQ ID NO: 69 - DNA, 39 bp, Homo sapiens
cagcagcagcagcaacagcagcagcagcagcagcagcag

SEQ ID NO: 70 - DNA, 30 bp, Homo sapiens
  misc_feature (1)..(30): This sequence may encompass 6-10 "tta" repeating units
ttattattattattattattattattatta

SEQ ID NO: 71 - DNA, 96 bp, Homo sapiens
  misc_feature (1)..(96): This sequence may encompass 22-32 "ctt" repeating units
cttcttcttcttcttcttcttcttcttcttcttcttcttcttcttcttcttcttcttcttcttcttcttcttcttcttcttcttcttcttcttctt

SEQ ID NO: 72 - DNA, 78 bp, Homo sapiens
  misc_feature (1)..(48): This region may encompass 10-16 "aat" repeating units
  modified_base (49)..(60): a, c, t, g, unknown or other
aataataataataataataataataataataataataataataataatnnnnnnnnnnnnaataataattattattat

SEQ ID NO: 73 - DNA, 66 bp, Homo sapiens
  misc_feature (1)..(3): This region may encompass 0-1 "ttt" repeating units
  misc_feature (4)..(66): This region may encompass 11-21 "tta" repeating units
tttttattattattattattattattattattattattattattattattattattattattatta

SEQ ID NO: 74 - DNA, 48 bp, Homo sapiens; identical to SEQ ID NO: 5
  misc_feature (1)..(48): This sequence may encompass 10-16 "aat" repeating units

SEQ ID NO: 75 - DNA, 48 bp, Homo sapiens
  misc_feature (1)..(48): This sequence may encompass 10-16 "ata" repeating units
ataataataataataataataataataataataataataataataata

SEQ ID NO: 76 - DNA, 45 bp, Homo sapiens
  misc_feature (1)..(45): This sequence may encompass 10-15 "tta" repeating units
ttattattattattattattattattattattattattattatta

SEQ ID NO: 77 - DNA, 48 bp, Homo sapiens
  misc_feature (1)..(48): This sequence may encompass 8-16 "tta" repeating units
ttattattattattattattattattattattattattattattatta

SEQ ID NO: 78 - DNA, 42 bp, Homo sapiens
  misc_feature (1)..(42): This sequence may encompass 8-14 "ata" repeating units
ataataataataataataataataataataataataataata

SEQ ID NO: 79 - DNA, 45 bp, Homo sapiens
  misc_feature (1)..(45): This sequence may encompass 9-15 "ata" repeating units
ataataataataataataataataataataataataataataata

SEQ ID NO: 80 - DNA, 33 bp, Homo sapiens
  misc_feature (1)..(33): This sequence may encompass 8-11 "aac" repeating units
aacaacaacaacaacaacaacaacaacaacaac

SEQ ID NO: 81 - DNA, 45 bp, Homo sapiens
  misc_feature (1)..(12): This region may encompass 4-6 "ta" repeating units
  misc_feature (13)..(45): This region may encompass 7-11 "taa" repeating units
tatatatatatataataataataataataataataataataataa

SEQ ID NO: 82 - DNA, 57 bp, Homo sapiens
  misc_feature (1)..(57): This sequence may encompass 12-19 "aat" repeating units
aataataataataataataataataataataataataataataataataataataat

SEQ ID NO: 83 - DNA, 48 bp, Homo sapiens; identical to SEQ ID NO: 77
  misc_feature (1)..(48): This sequence may encompass 9-16 "tta" repeating units

SEQ ID NO: 84 - DNA, 24 bp, Homo sapiens
ttgttgttgttgttgttgttgttg

SEQ ID NO: 85 - DNA, 42 bp, Homo sapiens
  misc_feature (16)..(42): This region may encompass 6-9 "cat" repeating units
aataataataattgccatcatcatcatcatcatcatcatcat

SEQ ID NO: 86 - DNA, 99 bp, Homo sapiens
  misc_feature (1)..(80): This region may encompass 10-20 "cctt" repeating units
  modified_base (81)..(87): a, c, t, g, unknown or other
ccttccttccttccttccttccttccttccttccttccttccttccttccttccttccttccttccttccttccttccttnnnnnnnccctccctccct

SEQ ID NO: 87 - DNA, 60 bp, Homo sapiens
  misc_feature (1)..(60): This sequence may encompass 9-15 "tcct" repeating units
tccttccttccttccttccttccttccttccttccttccttccttccttccttccttcct

SEQ ID NO: 88 - DNA, 60 bp, Homo sapiens
  misc_feature (1)..(60): This sequence may encompass 8-15 "tatc" repeating units
tatctatctatctatctatctatctatctatctatctatctatctatctatctatctatc

SEQ ID NO: 89 - DNA, 61 bp, Homo sapiens
  misc_feature (1)..(44): This region may encompass 7-11 "aaat" repeating units
aaataaataaataaataaataaataaataaataaataaataaataataaaaataaataaat

SEQ ID NO: 90 - DNA, 134 bp, Homo sapiens
  modified_base (13)..(24): a, c, t, g, unknown or other
  misc_feature (25)..(84): This region may encompass 9-15 "gata" repeating units
  modified_base (85)..(97): a, c, t, g, unknown or other
  modified_base (114)..(122): a, c, t, g, unknown or other
gatagatagatannnnnnnnnnnngatagatagatagatagatagatagatagatagatagatagatagatagatagatagatannnnnnnnnnnnnggatggatggatggatnnnnnnnnngatagatagata

SEQ ID NO: 91 - DNA, 56 bp, Homo sapiens
  misc_feature (1)..(56): This sequence may encompass 9-14 "gata" repeating units
gatagatagatagatagatagatagatagatagatagatagatagatagatagata

SEQ ID NO: 92 - DNA, 52 bp, Homo sapiens
  misc_feature (1)..(52): This sequence may encompass 7-13 "agat" repeating units
agatagatagatagatagatagatagatagatagatagatagatagatagat

SEQ ID NO: 93 - DNA, 96 bp, Homo sapiens
  misc_feature (37)..(96): This region may encompass 9-15 "tcta" repeating units
tctatctatctatctatccatatctatctatccgtatctatctatctatctatctatctatctatctatctatctatctatctatctatctatcta

SEQ ID NO: 94 - DNA, 118 bp, Homo sapiens
  modified_base (17)..(46): a, c, t, g, unknown or other
  misc_feature (47)..(118): This region may encompass 9-18 "ttct" repeating units
ttctttctttctttctnnnnnnnnnnnnnnnnnnnnnnnnnnnnnnttctttctttctttctttctttctttctttctttctttctttctttctttctttctttctttctttctttct

SEQ ID NO: 95 - DNA, 92 bp, Homo sapiens
  misc_feature (1)..(72): This region may encompass 10-18 "aaag" repeating units
  modified_base (73)..(80): a, c, t, g, unknown or other
aaagaaagaaagaaagaaagaaagaaagaaagaaagaaagaaagaaagaaagaaagaaagaaagaaagaaagnnnnnnnnaaagaaagaaag

SEQ ID NO: 96 - DNA, 249 bp, Homo sapiens
  misc_feature (17)..(104): This region may encompass 14-22 "aaag" repeating units
  modified_base (125)..(130): a, c, t, g, unknown or other
  misc_feature (131)..(206): This region may encompass 11-19 "aaag" repeating units
  modified_base (207)..(233): a, c, t, g, unknown or other
aaagaaagaaaggaagaaagaaagaaagaaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 97 - DNA, 96 bp, Homo sapiens
  misc_feature (1)..(52): This region may encompass 10-13 "gata" repeating units
  misc_feature (53)..(96): This region may encompass 10-11 "cata" repeating units
gatagatagatagatagatagatagatagatagatagatagatagatagatacatacatacatacatacatacatacatacatacatacatacata

SEQ ID NO: 98 - DNA, 113 bp, Homo sapiens
  misc_feature (58)..(113): This region may encompass 4-14 "cttt" repeating units
ctttctttctttctttcttttctttctttcttttttctttctttctttctttcttttctttctttctttctttctttctttctttctttctttctttctttctttctttcttt

SEQ ID NO: 99 - DNA, 60 bp, Homo sapiens
  misc_feature (1)..(60): This sequence may encompass 8-15 "atag" repeating units
atagatagatagatagatagatagatagatagatagatagatagatagatagatagatag

SEQ ID NO: 100 - DNA, 52 bp, Homo sapiens; identical to SEQ ID NO: 92
  misc_feature (1)..(52): This sequence may encompass 8-13 "agat" repeating units

SEQ ID NO: 101 - DNA, 68 bp, Homo sapiens
  misc_feature (1)..(68): This sequence may encompass 10-17 "cctt" repeating units
ccttccttccttccttccttccttccttccttccttccttccttccttccttccttccttccttcctt

SEQ ID NO: 102 - DNA, 321 bp, Homo sapiens
  modified_base (13)..(32): a, c, t, g, unknown or other
  misc_feature (33)..(100): This region may encompass 11-17 "cttt" repeating units
  misc_feature (101)..(140): This region may encompass 6-10 "cctt" repeating units
  modified_base (141)..(253): a, c, t, g, unknown or other
  misc_feature (254)..(321): This region may encompass 10-17 "cctt" repeating units
ccctccctccctnnnnnnnnnnnnnnnnnnnnctttctttctttctttctttctttctttctttctttctttctttctttctttctttctttctttctttccttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttccttccttccttcctt

SEQ ID NO: 103 - DNA, 44 bp, Homo sapiens
  misc_feature (1)..(44): This sequence may encompass 8-11 "aaac" repeating units
aaacaaacaaacaaacaaacaaacaaacaaacaaacaaacaaac

SEQ ID NO: 104 - DNA, 52 bp, Homo sapiens; identical to SEQ ID NO: 19
  misc_feature (1)..(52): This sequence may encompass 9-13 "aaat" repeating units

SEQ ID NO: 105 - DNA, 288 bp, Homo sapiens
  modified_base (13)..(17): a, c, t, g, unknown or other
  modified_base (38)..(46): a, c, t, g, unknown or other
  misc_feature (63)..(130): This region may encompass 6-17 "ttct" repeating units
  modified_base (131)..(147): a, c, t, g, unknown or other
  modified_base (160)..(172): a, c, t, g, unknown or other
  modified_base (189)..(258): a, c, t, g, unknown or other
  modified_base (271)..(276): a, c, t, g, unknown or other
tccctccctcccnnnnnttccttccttccttccttccnnnnnnnnnttctttctttctttccttctttctttctttctttctttctttctttctttctttctttctttctttctttctttctttctttctnnnnnnnnnnnnnnnnnttctttctttctnnnnnnnnnnnnnttccttccttccttccnnnnnnnnnnnnnnnnnnnnnnnnnnnnnnnnnnnnnnnnnnnnnnnnnnnnnnnnnnnnnnnnnnnnnnttctttctttctnnnnnnttctttctttct

SEQ ID NO: 106 - DNA, 56 bp, Homo sapiens; identical to SEQ ID NO: 18
  misc_feature (1)..(56): This sequence may encompass 9-14 "tatc" repeating units

SEQ ID NO: 107 - DNA, 121 bp, Homo sapiens
  modified_base (13)..(20): a, c, t, g, unknown or other
  misc_feature (21)..(100): This region may encompass 9-20 "cttt" repeating units
  modified_base (101)..(109): a, c, t, g, unknown or other
ctttctttctttnnnnnnnnctttctttctttctttctttctttctttctttctttctttctttctttctttctttctttctttctttctttctttctttnnnnnnnnnctttctttcttt

SEQ ID NO: 108 - DNA, 100 bp, Homo sapiens
  misc_feature (1)..(76): This region may encompass 7-19 "tcct" repeating units
  modified_base (77)..(84): a, c, t, g, unknown or other
tccttccttccttccttccttccttccttccttccttccttccttccttccttccttccttccttccttccttcctnnnnnnnnttctttctttctttct

SEQ ID NO: 109 - DNA, 52 bp, Homo sapiens
  misc_feature (1)..(52): This sequence may encompass 8-13 "tcta" repeating units
tctatctatctatctatctatctatctatctatctatctatctatctatcta

SEQ ID NO: 110 - DNA, 52 bp, Homo sapiens
  misc_feature (1)..(52): This sequence may encompass 9-13 "gata" repeating units
gatagatagatagatagatagatagatagatagatagatagatagatagata

SEQ ID NO: 111 - DNA, 56 bp, Homo sapiens
  misc_feature (1)..(56): This sequence may encompass 8-14 "taga" repeating units
tagatagatagatagatagatagatagatagatagatagatagatagatagataga

SEQ ID NO: 112 - DNA, 56 bp, Homo sapiens
  misc_feature (1)..(56): This sequence may encompass 9-14 "ttat" repeating units
ttatttatttatttatttatttatttatttatttatttatttatttatttatttat

SEQ ID NO: 113 - DNA, 75 bp, Homo sapiens
  misc_feature (1)..(60): This region may encompass 10-15 "tatc" repeating units
tatctatctatctatctatctatctatctatctatctatctatctatctatctatctatcttctatctatctatc

SEQ ID NO: 114 - DNA, 193 bp, Homo sapiens
  misc_feature (13)..(76): This region may encompass 7-16 "gata" repeating units
  modified_base (77)..(118): a, c, t, g, unknown or other
  misc_feature (119)..(134): This region may encompass 3-4 "atgt" repeating units
  misc_feature (135)..(146): This region may encompass 2-3 "atgg" repeating units
  modified_base (147)..(181): a, c, t, g, unknown or other
  see specification as filed for detailed description of substitutions and preferred embodiments
agatagatagatgatagatagatagatagatagatagatagatagatagatagatagatagatagatagatagatannnnnnnnnnnnnnnnnnnnnnnnnnnnnnnnnnnnnnnnnnatgtatgtatgtatgtatggatggatggnnnnnnnnnnnnnnnnnnnnnnnnnnnnnnnnnnngaaagaaagaaa

SEQ ID NO: 115 - DNA, 91 bp, Homo sapiens
  modified_base (13)..(27): a, c, t, g, unknown or other
  misc_feature (44)..(91): This region may encompass 6-12 "taga" repeating units
tagatagatagannnnnnnnnnnnnnntagatagatagatggatagatagatagatagatagatagatagatagatagatagatagataga

SEQ ID NO: 116 - DNA, 44 bp, Homo sapiens
  misc_feature (1)..(44): This sequence may encompass 8-11 "tgtt" repeating units
tgtttgtttgtttgtttgtttgtttgtttgtttgtttgtttgtt

SEQ ID NO: 117 - DNA, 184 bp, Homo sapiens
  modified_base (13)..(35): a, c, t, g, unknown or other
  modified_base (48)..(80): a, c, t, g, unknown or other
  modified_base (93)..(108): a, c, t, g, unknown or other
  misc_feature (109)..(184): This region may encompass 9-19 "ttct" repeating units
ttccttccttccnnnnnnnnnnnnnnnnnnnnnnnttctttctttctnnnnnnnnnnnnnnnnnnnnnnnnnnnnnnnnnttccttccttccnnnnnnnnnnnnnnnnttctttctttctttctttctttctttctttctttctttctttctttctttctttctttctttctttctttctttct

SEQ ID NO: 118 - DNA, 337 bp, Homo sapiens
  misc_feature (1)..(52): This region may encompass 9-13 "cctt" repeating units
  misc_feature (54)..(73): This region may encompass 4-5 "cttc" repeating units
  modified_base (74)..(129): a, c, t, g, unknown or other
  misc_feature (130)..(217): This region may encompass 10-22 "tttc" repeating units
  modified_base (218)..(227): a, c, t, g, unknown or other
  misc_feature (248)..(311): This region may encompass 9-16 "tttc" repeating units
  modified_base (312)..(325): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttctttctttctttctttcnnnnnnnnnnccttccttccttcctttctctttctttctttctttctttctttctttctttctttctttctttctttctttctttctttctttcnnnnnnnnnnnnnntttctttctttc

SEQ ID NO: 119 - DNA, 60 bp, Homo sapiens
  misc_feature (1)..(60): This sequence may encompass 9-15 "gata" repeating units
gatagatagatagatagatagatagatagatagatagatagatagatagatagatagata

SEQ ID NO: 120 - DNA, 96 bp, Homo sapiens
  modified_base (17)..(32): a, c, t, g, unknown or other
  misc_feature (53)..(96): This region may encompass 6-11 "aagg" repeating units
aaggaaggaaggaaggnnnnnnnnnnnnnnnnaaggaaggaaggaaggaaagaaggaaggaaggaaggaaggaaggaaggaaggaaggaaggaagg

SEQ ID NO: 121 - DNA, 104 bp, Homo sapiens
  misc_feature (1)..(64): This region may encompass 10-16 "agat" repeating units
  modified_base (65)..(72): a, c, t, g, unknown or other
agatagatagatagatagatagatagatagatagatagatagatagatagatagatagatagatnnnnnnnnagacagacagacaggtagatagatagatagat

SEQ ID NO: 122 - DNA, 168 bp, Homo sapiens
  misc_feature (17)..(64): This region may encompass 7-12 "tcta" repeating units
  modified_base (65)..(104): a, c, t, g, unknown or other
  misc_feature (105)..(168): This region may encompass 11-16 "tcta" repeating units
tctatctatctatctgtctatctatctatctatctatctatctatctatctatctatctatctannnnnnnnnnnnnnnnnnnnnnnnnnnnnnnnnnnnnnnntctatctatctatctatctatctatctatctatctatctatctatctatctatctatctatcta

SEQ ID NO: 123 - DNA, 44 bp, Homo sapiens
  misc_feature (1)..(44): This sequence may encompass 8-11 "taaa" repeating units
taaataaataaataaataaataaataaataaataaataaataaa

SEQ ID NO: 124 - DNA, 48 bp, Homo sapiens
  misc_feature (1)..(48): This sequence may encompass 8-12 "aaat" repeating units
aaataaataaataaataaataaataaataaataaataaataaataaat

SEQ ID NO: 125 - DNA, 124 bp, Homo sapiens
  misc_feature (41)..(124): This region may encompass 12-21 "tttc" repeating units
tttctttctttctttcttctctttctttctttctttcttctttctttctttctttctttctttctttctttctttctttctttctttctttctttctttctttctttctttctttctttctttc

SEQ ID NO: 126 - DNA, 52 bp, Homo sapiens
  misc_feature (13)..(52): This region may encompass 5-10 "ttta" repeating units
tttgtttgtttgtttatttatttatttatttatttatttatttatttattta

SEQ ID NO: 127 - DNA, 36 bp, Homo sapiens
  misc_feature (1)..(36): This sequence may encompass 7-9 "taaa" repeating units
taaataaataaataaataaataaataaataaataaa

SEQ ID NO: 128 - DNA, 68 bp, Homo sapiens
  misc_feature (1)..(52): This region may encompass 9-13 "gata" repeating units
gatagatagatagatagatagatagatagatagatagatagatagatagatagacagacagacagaca

SEQ ID NO: 129 - DNA, 56 bp, Homo sapiens
  misc_feature (1)..(56): This sequence may encompass 9-14 "ataa" repeating units
ataaataaataaataaataaataaataaataaataaataaataaataaataaataa

SEQ ID NO: 130 - DNA, 52 bp, Homo sapiens
  misc_feature (1)..(52): This sequence may encompass 7-13 "ataa" repeating units
ataaataaataaataaataaataaataaataaataaataaataaataaataa

SEQ ID NO: 131 - DNA, 52 bp, Homo sapiens; identical to SEQ ID NO: 19
  misc_feature (1)..(52): This sequence may encompass 9-13 "aaat" repeating units

SEQ ID NO: 132 - DNA, 52 bp, Homo sapiens
  misc_feature (1)..(52): This sequence may encompass 8-13 "attt" repeating units
  see specification as filed for detailed description of substitutions and preferred embodiments
atttatttatttatttatttatttatttatttatttatttatttatttattt

SEQ ID NO: 133 - DNA, 96 bp, Homo sapiens
  misc_feature (1)..(96): This sequence may encompass 14-24 "tttc" repeating units
tttctttctttctttctttctttctttctttctttctttctttctttctttctttctttctttctttctttctttctttctttctttctttctttc

SEQ ID NO: 134 - DNA, 75 bp, Homo sapiens
  modified_base (21)..(27): a, c, t, g, unknown or other
  misc_feature (28)..(75): This region may encompass 9-12 "ttta" repeating units
ttttcttttcttttcttttcnnnnnnntttatttatttatttatttatttatttatttatttatttatttattta

SEQ ID NO: 135 - DNA, 52 bp, Homo sapiens; identical to SEQ ID NO: 19
  misc_feature (1)..(52): This sequence may encompass 8-13 "aaat" repeating units

SEQ ID NO: 136 - DNA, 52 bp, Homo sapiens
  misc_feature (1)..(52): This sequence may encompass 8-13 "ttta" repeating units
tttatttatttatttatttatttatttatttatttatttatttatttattta

SEQ ID NO: 137 - DNA, 48 bp, Homo sapiens
  misc_feature (1)..(48): This sequence may encompass 8-12 "ttat" repeating units
ttatttatttatttatttatttatttatttatttatttatttatttat

SEQ ID NO: 138 - DNA, 44 bp, Homo sapiens
  misc_feature (1)..(44): This sequence may encompass 8-11 "aaat" repeating units
aaataaataaataaataaataaataaataaataaataaataaat

SEQ ID NO: 139 - DNA, 88 bp, Homo sapiens
  misc_feature (1)..(88): This sequence may encompass 13-22 "aaag" repeating units
aaagaaagaaagaaagaaagaaagaaagaaagaaagaaagaaagaaagaaagaaagaaagaaagaaagaaagaaagaaagaaagaaag

SEQ ID NO: 140 - DNA, 40 bp, Homo sapiens
  misc_feature (1)..(40): This sequence may encompass 6-10 "attc" repeating units
attcattcattcattcattcattcattcattcattcattc

SEQ ID NO: 141 - DNA, 40 bp, Homo sapiens
  misc_feature (1)..(40): This sequence may encompass 7-10 "aaat" repeating units
aaataaataaataaataaataaataaataaataaataaat

SEQ ID NO: 142 - DNA, 40 bp, Homo sapiens
  misc_feature (1)..(40): This sequence may encompass 7-10 "tatt" repeating units
tatttatttatttatttatttatttatttatttatttatt

SEQ ID NO: 143 - DNA, 40 bp, Homo sapiens
  misc_feature (1)..(40): This sequence may encompass 8-10 "aata" repeating units
aataaataaataaataaataaataaataaataaataaata

SEQ ID NO: 144 - DNA, 36 bp, Homo sapiens
  misc_feature (1)..(36): This sequence may encompass 7-9 "tagg" repeating units
taggtaggtaggtaggtaggtaggtaggtaggtagg

SEQ ID NO: 145 - DNA, 36 bp, Homo sapiens
  misc_feature (1)..(36): This sequence may encompass 7-9 "aaac" repeating units
aaacaaacaaacaaacaaacaaacaaacaaacaaac

SEQ ID NO: 146 - DNA, 32 bp, Homo sapiens
  misc_feature (1)..(32): This sequence may encompass 7-8 "caat" repeating units
caatcaatcaatcaatcaatcaatcaatcaat

SEQ ID NO: 147 - DNA, 60 bp, Homo sapiens
  misc_feature (1)..(60): This sequence may encompass 8-12 "ttatg" repeating units
ttatgttatgttatgttatgttatgttatgttatgttatgttatgttatgttatgttatg

SEQ ID NO: 148 - DNA, 110 bp, Homo sapiens
  misc_feature (1)..(80): This region may encompass 8-16 "caata" repeating units
caatacaatacaatacaatacaatacaatacaatacaatacaatacaatacaatacaatacaatacaatacaatacaatacagtacaatacagtacaatacagtacaata

SEQ ID NO: 149 - DNA, 80 bp, Homo sapiens
  misc_feature (1)..(80): This sequence may encompass 9-16 "gcatt" repeating units
gcattgcattgcattgcattgcattgcattgcattgcattgcattgcattgcattgcattgcattgcattgcattgcatt

SEQ ID NO: 150 - DNA, 45 bp, Homo sapiens
  misc_feature (1)..(45): This sequence may encompass 5-9 "ttttg" repeating units
ttttgttttgttttgttttgttttgttttgttttgttttgttttg

SEQ ID NO: 151 - DNA, 70 bp, Homo sapiens
  misc_feature (21)..(70): This region may encompass 7-10 "aaaat" repeating units
aaaacaaaacaaaacaaaacaaaataaaataaaataaaataaaataaaataaaataaaataaaataaaat

SEQ ID NO: 152 - DNA, 65 bp, Homo sapiens
  misc_feature (1)..(65): This sequence may encompass 8-13 "aaata" repeating units
aaataaaataaaataaaataaaataaaataaaataaaataaaataaaataaaataaaataaaata

SEQ ID NO: 153 - DNA, 45 bp, Homo sapiens
  misc_feature (1)..(45): This sequence may encompass 6-9 "attta" repeating units
atttaatttaatttaatttaatttaatttaatttaatttaattta

SEQ ID NO: 154 - DNA, 96 bp, Homo sapiens
  misc_feature (37)..(96): This region may encompass 8-10 "ggagaa" repeating units
ggaggaggaggaggagtaggaggaggagaagaagaaggagaaggagaaggagaaggagaaggagaaggagaaggagaaggagaaggagaaggagaa

SEQ ID NO: 155 - DNA, 348 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  misc_feature (217)..(279): This region may encompass 7-21 "ttc" repeating units
  modified_base (280)..(302): a, c, t, g, unknown or other
  modified_base (315)..(318): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 156 - DNA, 126 bp, Homo sapiens
  misc_feature (34)..(126): This region may encompass 19-31 "tct" repeating units
cctcctcctcctcctctttcttcttcttctccttcttcttcttcttcttcttcttcttcttcttcttcttcttcttcttcttcttcttcttcttcttcttcttcttcttcttcttcttcttcttct

SEQ ID NO: 157 - DNA, 54 bp, Homo sapiens
  misc_feature (28)..(54): This region may encompass 8-9 "atg" repeating units
atgatgatgatgatgatgatgatgataatgatgatgatgatgatgatgatgatg

SEQ ID NO: 158 - DNA, 282 bp, Homo sapiens
  modified_base (25)..(39): a, c, t, g, unknown or other
  modified_base (76)..(93): a, c, t, g, unknown or other
  modified_base (118)..(137): a, c, t, g, unknown or other
  misc_feature (158)..(223): This region may encompass 12-22 "ctt" repeating units
  modified_base (224)..(231): a, c, t, g, unknown or other
cttcttcttcttcctcttcttcttnnnnnnnnnnnnnnncctcctcctcctcttcttcttcttcctcttcttcttnnnnnnnnnnnnnnnnnncctcctcctcttcttcttcttcttnnnnnnnnnnnnnnnnnnnncttctgcttctgcttctgctcttcttcttcttcttcttcttcttcttcttcttcttcttcttcttcttcttcttcttcttcttcttnnnnnnnncttcttcttcttctccttctccttctccttctctttcttcttcttcttctt

SEQ ID NO: 159 - DNA, 24 bp, Homo sapiens
  misc_feature (1)..(24): This sequence may encompass 7-8 "ttg" repeating units
ttgttgttgttgttgttgttgttg

SEQ ID NO: 160 - DNA, 60 bp, Homo sapiens
  misc_feature (1)..(48): This region may encompass 8-16 "tat" repeating units
tattattattattattattattattattattattattattattattatcattattattat

SEQ ID NO: 161 - DNA, 45 bp, Homo sapiens; identical to SEQ ID NO: 76
  misc_feature (1)..(45): This sequence may encompass 11-15 "tta" repeating units

SEQ ID NO: 162 - DNA, 42 bp, Homo sapiens
  misc_feature (1)..(42): This sequence may encompass 8-14 "tat" repeating units
tattattattattattattattattattattattattattat

SEQ ID NO: 163 - DNA, 30 bp, Homo sapiens
  misc_feature (1)..(30): This sequence may encompass 6-10 "aat" repeating units
aataataataataataataataataataat

SEQ ID NO: 164 - DNA, 27 bp, Homo sapiens
  misc_feature (1)..(27): This sequence may encompass 8-9 "ata" repeating units
ataataataataataataataataata

SEQ ID NO: 165 - DNA, 27 bp, Homo sapiens
  misc_feature (1)..(27): This sequence may encompass 7-9 "tta" repeating units
ttattattattattattattattatta

SEQ ID NO: 166 - DNA, 93 bp, Homo sapiens
  misc_feature (30)..(93): This region may encompass 8-16 "gaaa" repeating units
gaaagaaagaaagaaagaaagaaaagaaggaaagaaagaaagaaagaaagaaagaaagaaagaaagaaagaaagaaagaaagaaagaaagaaa

SEQ ID NO: 167 - DNA, 91 bp, Homo sapiens
  misc_feature (1)..(40): This region may encompass 8-10 "ggat" repeating units
  modified_base (45)..(79): a, c, t, g, unknown or other
ggatggatggatggatggatggatggatggatggatggatrgatnnnnnnnnnnnnnnnnnnnnnnnnnnnnnnnnnnnggatggatggat

SEQ ID NO: 168 - DNA, 188 bp, Homo sapiens
  modified_base (66)..(112): a, c, t, g, unknown or other
  misc_feature (113)..(132): This region may encompass 3-5 "cttt" repeating units
  modified_base (167)..(176): a, c, t, g, unknown or other
ctttctttctttctttttctctttctttcttttttctttctttctttctttttctttctttctttnnnnnnnnnnnnnnnnnnnnnnnnnnnnnnnnnnnnnnnnnnnnnnnctttctttctttctttctttctctttctttctttctttccttctttctttctttnnnnnnnnnnctttctttcttt

SEQ ID NO: 169 - DNA, 185 bp, Homo sapiens
  misc_feature (1)..(92): This region may encompass 14-23 "gaaa" repeating units
  modified_base (93)..(116): a, c, t, g, unknown or other
  modified_base (129)..(134): a, c, t, g, unknown or other
  misc_feature (158)..(169): This region may encompass 2-3 "gaaa" repeating units
gaaagaaagaaagaaagaaagaaagaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaagaaggaaagaaagaaa

SEQ ID NO: 170 - DNA, 229 bp, Homo sapiens
  modified_base (13)..(28): a, c, t, g, unknown or other
  misc_feature (41)..(136): This region may encompass 12-24 "aaag" repeating units
  modified_base (137)..(217): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 171 - DNA, 48 bp, Homo sapiens
  misc_feature (1)..(48): This sequence may encompass 5-12 "tatc" repeating units
tatctatctatctatctatctatctatctatctatctatctatctatc

SEQ ID NO: 172 - DNA, 130 bp, Homo sapiens
  modified_base (29)..(46): a, c, t, g, unknown or other
  misc_feature (47)..(130): This region may encompass 12-21 "aaag" repeating units
aaagaaagaaagaaagagagagagagagnnnnnnnnnnnnnnnnnnaaagaaagaaagaaagaaagaaagaaagaaagaaagaaagaaagaaagaaagaaagaaagaaagaaagaaagaaagaaagaaag

SEQ ID NO: 173 - DNA, 64 bp, Homo sapiens
  misc_feature (21)..(64): This region may encompass 7-11 "aata" repeating units
aataaataaataaatacataaataaataaataaataaataaataaataaataaataaataaata

SEQ ID NO: 174 - DNA, 40 bp, Homo sapiens
  misc_feature (1)..(40): This sequence may encompass 8-10 "catt" repeating units
cattcattcattcattcattcattcattcattcattcatt

SEQ ID NO: 175 - DNA, 72 bp, Homo sapiens
  modified_base (21)..(36): a, c, t, g, unknown or other
  misc_feature (37)..(72): This region may encompass 7-9 "aaat" repeating units
aaataaataaataaataaatnnnnnnnnnnnnnnnnaaataaataaataaataaataaataaataaataaat

SEQ ID NO: 176 - DNA, 101 bp, Homo sapiens
  modified_base (25)..(34): a, c, t, g, unknown or other
  misc_feature (35)..(74): This region may encompass 7-10 "aagg" repeating units
  modified_base (75)..(86): a, c, t, g, unknown or other
ggaaggaaggaaggaaggaaggaannnnnnnnnnaaggaaggaaggaaggaaggaaggaaggaaggaaggaaggnnnnnnnnnnnnaggggaggggagggg

SEQ ID NO: 177 - DNA, 124 bp, Homo sapiens
  misc_feature (49)..(56): This region may encompass 0-2 "tatg" repeating units
  misc_feature (57)..(124): This region may encompass 4-17 "tcta" repeating units
tctatctatctatctatgtatgtatctatctatgtatgtatctatctatatgtatgtctatctatctatctatctatctatctatctatctatctatctatctatctatctatctatctatcta

SEQ ID NO: 178 - DNA, 72 bp, Homo sapiens
  misc_feature (17)..(72): This region may encompass 8-14 "acat" repeating units
aaataaataaataaatacatacatacatacatacatacatacatacatacatacatacatacatacatacat

SEQ ID NO: 179 - DNA, 52 bp, Homo sapiens; identical to SEQ ID NO: 136
  misc_feature (1)..(52): This sequence may encompass 8-13 "ttta" repeating units

SEQ ID NO: 180 - DNA, 52 bp, Homo sapiens; identical to SEQ ID NO: 19
  misc_feature (1)..(52): This sequence may encompass 9-13 "aaat" repeating units

SEQ ID NO: 181 - DNA, 48 bp, Homo sapiens
  misc_feature (1)..(48): This sequence may encompass 8-12 "taaa" repeating units
taaataaataaataaataaataaataaataaataaataaataaataaa

SEQ ID NO: 182 - DNA, 40 bp, Homo sapiens
  misc_feature (1)..(40): This sequence may encompass 6-10 "taaa" repeating units
taaataaataaataaataaataaataaataaataaataaa

SEQ ID NO: 183 - DNA, 75 bp, Homo sapiens
  misc_feature (1)..(75): This sequence may encompass 6-15 "ctttt" repeating units
cttttcttttcttttcttttcttttcttttcttttcttttcttttcttttcttttcttttcttttcttttctttt

SEQ ID NO: 184 - DNA, 124 bp, Homo sapiens
  misc_feature (1)..(55): This region may encompass 10-11 "tttta" repeating units
  misc_feature (56)..(59): This region may encompass 0-1 "ttta" repeating units
  misc_feature (60)..(124): This region may encompass 0-13 "tttta" repeating units
ttttattttattttattttattttattttattttattttattttattttattttatttattttattttattttattttattttattttattttattttattttattttattttattttatttta

SEQ ID NO: 185 - DNA, 45 bp, Homo sapiens
  misc_feature (1)..(45): This sequence may encompass 7-9 "tgttt" repeating units
tgttttgttttgttttgttttgttttgttttgttttgttttgttt

SEQ ID NO: 186 - DNA, 64 bp, Homo sapiens
  misc_feature (1)..(64): This sequence may encompass 11-16 "atct" repeating units
atctatctatctatctatctatctatctatctatctatctatctatctatctatctatctatct

SEQ ID NO: 187 - DNA, 134 bp, Homo sapiens
  modified_base (13)..(24): a, c, t, g, unknown or other
  misc_feature (37)..(96): This region may encompass 8-15 "taga" repeating units
  modified_base (97)..(118): a, c, t, g, unknown or other
tagatagatagannnnnnnnnnnntaggtaggtaggtagatagatagatagatagatagatagatagatagatagatagatagatagatagatagannnnnnnnnnnnnnnnnnnnnntagatagatagataga

SEQ ID NO: 188 - DNA, 20 bp, Artificial Sequence
  Description of Artificial Sequence: Synthetic primer
agccatgtggattcaccact

SEQ ID NO: 189 - DNA, 20 bp, Artificial Sequence
  Description of Artificial Sequence: Synthetic primer
tccatccatcaatccatcaa

SEQ ID NO: 190 - DNA, 20 bp, Artificial Sequence
  Description of Artificial Sequence: Synthetic primer
caacccaaacacttgcagaa

SEQ ID NO: 191 - DNA, 20 bp, Artificial Sequence
  Description of Artificial Sequence: Synthetic primer
ttgtaaaatgggcatgtgga

SEQ ID NO: 192 - DNA, 20 bp, Artificial Sequence
  Description of Artificial Sequence: Synthetic primer
gactgctcaactgcactcca

SEQ ID NO: 193 - DNA, 20 bp, Artificial Sequence
  Description of Artificial Sequence: Synthetic primer
gcctgggtgacagagctaga

SEQ ID NO: 194 - DNA, 23 bp, Artificial Sequence
  Description of Artificial Sequence: Synthetic primer
ttctaggaagattagccacaaca

SEQ ID NO: 195 - DNA, 20 bp, Artificial Sequence
  Description of Artificial Sequence: Synthetic primer
agcattccctttctcattgc

SEQ ID NO: 196 - DNA, 20 bp, Artificial Sequence
  Description of Artificial Sequence: Synthetic primer
gcaaccaaaaggtttggaga

SEQ ID NO: 197 - DNA, 20 bp, Artificial Sequence
  Description of Artificial Sequence: Synthetic primer
gccctgaacaaaatctggag

SEQ ID NO: 198 - DNA, 22 bp, Artificial Sequence
  Description of Artificial Sequence: Synthetic primer
tgcacgtcttcatacatagagc

SEQ ID NO: 199 - DNA, 20 bp, Artificial Sequence
  Description of Artificial Sequence: Synthetic primer
gggttttcaccagtttgcat

SEQ ID NO: 200 - DNA, 20 bp, Artificial Sequence
  Description of Artificial Sequence: Synthetic primer
tcgcaaacatagcacttcag

SEQ ID NO: 201 - DNA, 22 bp, Artificial Sequence
  Description of Artificial Sequence: Synthetic primer
caaaattcatgtggataatgag

SEQ ID NO: 202 - DNA, 22 bp, Artificial Sequence
  Description of Artificial Sequence: Synthetic primer
caaaattcatgtggataatgag

SEQ ID NO: 203 - DNA, 23 bp, Artificial Sequence
  Description of Artificial Sequence: Synthetic primer
ggcttaagaaatttcaacgcata

SEQ ID NO: 204 - DNA, 20 bp, Artificial Sequence
  Description of Artificial Sequence: Synthetic primer
ccgtggtgtctgaagcatag

SEQ ID NO: 205 - DNA, 21 bp, Artificial Sequence
  Description of Artificial Sequence: Synthetic primer
cctgggtgacacagtgagact

SEQ ID NO: 206 - DNA, 20 bp, Artificial Sequence
  Description of Artificial Sequence: Synthetic primer
tgacgagttagtgggtgcag

SEQ ID NO: 207 - DNA, 20 bp, Artificial Sequence
  Description of Artificial Sequence: Synthetic primer
gtgagttagccgtttagcga

SEQ ID NO: 208 - DNA, 21 bp, Artificial Sequence
  Description of Artificial Sequence: Synthetic primer
tggagagaagaagagagaaat

SEQ ID NO: 209 - DNA, 23 bp, Artificial Sequence
  Description of Artificial Sequence: Synthetic primer
ctcaaagtatgaaagcatgacca

SEQ ID NO: 210 - DNA, 20 bp, Artificial Sequence
  Description of Artificial Sequence: Synthetic primer
cactccctgagtgctggatt

SEQ ID NO: 211 - DNA, 20 bp, Artificial Sequence
  Description of Artificial Sequence: Synthetic primer
agcatctccacacagcacac

SEQ ID NO: 212 - DNA, 20 bp, Artificial Sequence
  Description of Artificial Sequence: Synthetic primer
ccaggagagcacacacaaaa

SEQ ID NO: 213 - DNA, 23 bp, Artificial Sequence
  Description of Artificial Sequence: Synthetic primer
atgtacctgtagccccagtgaac

SEQ ID NO: 214 - DNA, 23 bp, Artificial Sequence
  Description of Artificial Sequence: Synthetic primer
aaacgcccatcaatcaatgagtg

SEQ ID NO: 215 - DNA, 21 bp, Artificial Sequence
  Description of Artificial Sequence: Synthetic primer
gagttcatgctgatgacaagc

SEQ ID NO: 216 - DNA, 20 bp, Artificial Sequence
  Description of Artificial Sequence: Synthetic primer
tgtgaaccatttggcatgtt

SEQ ID NO: 217 - DNA, 22 bp, Artificial Sequence
  Description of Artificial Sequence: Synthetic primer
gagctgagattatgccaccaaa

SEQ ID NO: 218 - DNA, 21 bp, Artificial Sequence
  Description of Artificial Sequence: Synthetic primer
tattttcagtcttgtcctgtc

SEQ ID NO: 219 - DNA, 20 bp, Artificial Sequence
  Description of Artificial Sequence: Synthetic primer
gggcttgctttgcgttatct

SEQ ID NO: 220 - DNA, 21 bp, Artificial Sequence
  Description of Artificial Sequence: Synthetic primer
tggagtctctcaagcctgttc

SEQ ID NO: 221 - DNA, 23 bp, Artificial Sequence
  Description of Artificial Sequence: Synthetic primer
gcctttccaatttcaatttctga

SEQ ID NO: 222 - DNA, 28 bp, Artificial Sequence
  Description of Artificial Sequence: Synthetic primer
tttattatactcagctaattaattggtt

SEQ ID NO: 223 - DNA, 20 bp, Artificial Sequence
  Description of Artificial Sequence: Synthetic primer
gggtaacagaacaagacagt

SEQ ID NO: 224 - DNA, 20 bp, Artificial Sequence
  Description of Artificial Sequence: Synthetic primer
tcacaatgacccttttgtgc

SEQ ID NO: 225 - DNA, 21 bp, Artificial Sequence
  Description of Artificial Sequence: Synthetic primer
atctgagccgagagaatgata

SEQ ID NO: 226 - DNA, 22 bp, Artificial Sequence
  Description of Artificial Sequence: Synthetic primer
caggtgaactggggtaaataat

SEQ ID NO: 227 - DNA, 20 bp, Artificial Sequence
  Description of Artificial Sequence: Synthetic primer
gccaaactctttccaagaag

SEQ ID NO: 228 - DNA, 24 bp, Artificial Sequence
  Description of Artificial Sequence: Synthetic primer
aggcagaggatagatgatatggat

SEQ ID NO: 229 - DNA, 20 bp, Artificial Sequence
  Description of Artificial Sequence: Synthetic primer
tgtgctgtaccagttgccta

SEQ ID NO: 230 - DNA, 23 bp, Artificial Sequence
  Description of Artificial Sequence: Synthetic primer
aattctaggtttgagcaaagaca

SEQ ID NO: 231 - DNA, 19 bp, Artificial Sequence
  Description of Artificial Sequence: Synthetic primer
ttacgagctttgggctatg

SEQ ID NO: 232 - DNA, 22 bp, Artificial Sequence
  Description of Artificial Sequence: Synthetic primer
gggagttccaaactttttcaca

SEQ ID NO: 233 - DNA, 20 bp, Artificial Sequence
  Description of Artificial Sequence: Synthetic primer
tttggggactgaattcaaaa

SEQ ID NO: 234 - DNA, 20 bp, Artificial Sequence
  Description of Artificial Sequence: Synthetic primer
ggtccttcaggaaccagttg

SEQ ID NO: 235 - DNA, 20 bp, Artificial Sequence
  Description of Artificial Sequence: Synthetic primer
agattgtcccacctgcactc

SEQ ID NO: 236 - DNA, 20 bp, Artificial Sequence
  Description of Artificial Sequence: Synthetic primer
cagcctggatagcagagtga

SEQ ID NO: 237 - DNA, 21 bp, Artificial Sequence
  Description of Artificial Sequence: Synthetic primer
cccctgaacttaaaaggtgga

SEQ ID NO: 238 - DNA, 19 bp, Artificial Sequence
  Description of Artificial Sequence: Synthetic primer
cccaccaagggttttcaga

SEQ ID NO: 239 - DNA, 20 bp, Artificial Sequence
  Description of Artificial Sequence: Synthetic primer
cgactatgatttgggctgtg

SEQ ID NO: 240 - DNA, 22 bp, Artificial Sequence
  Description of Artificial Sequence: Synthetic primer
taacttacagaaaagctcaggg

SEQ ID NO: 241 - DNA, 19 bp, Artificial Sequence
  Description of Artificial Sequence: Synthetic primer
acaggcaacaaattgggta

SEQ ID NO: 242 - DNA, 20 bp, Artificial Sequence
  Description of Artificial Sequence: Synthetic primer
ccagcacctaggttgaggta

SEQ ID NO: 243 - DNA, 20 bp, Artificial Sequence
  Description of Artificial Sequence: Synthetic primer
aggaatgtggctaacgctgt

SEQ ID NO: 244 - DNA, 20 bp, Artificial Sequence
  Description of Artificial Sequence: Synthetic primer
cctatcatccgcatggactt

SEQ ID NO: 245 - DNA, 21 bp, Artificial Sequence
  Description of Artificial Sequence: Synthetic primer
aaagcagacttcgccactaca

SEQ ID NO: 246 - DNA, 20 bp, Artificial Sequence
  Description of Artificial Sequence: Synthetic primer
tgtgggaggccttaagaaaa

SEQ ID NO: 247 - DNA, 20 bp, Artificial Sequence
  Description of Artificial Sequence: Synthetic primer
ggggagggatagcattagga

SEQ ID NO: 248 - DNA, 20 bp, Artificial Sequence
  Description of Artificial Sequence: Synthetic primer
acccaaagatttgtcggcta

SEQ ID NO: 249 - DNA, 20 bp, Artificial Sequence
  Description of Artificial Sequence: Synthetic primer
cctggcaggaattatccaga

SEQ ID NO: 250 - DNA, 20 bp, Artificial Sequence
  Description of Artificial Sequence: Synthetic primer
ggaatggggagggataacat

SEQ ID NO: 251 - DNA, 20 bp, Artificial Sequence
  Description of Artificial Sequence: Synthetic primer
agatgagccaggcttcagac

SEQ ID NO: 252 - DNA, 20 bp, Artificial Sequence
  Description of Artificial Sequence: Synthetic primer
actccagtctgggtggacag

SEQ ID NO: 253 - DNA, 21 bp, Artificial Sequence
  Description of Artificial Sequence: Synthetic primer
ttgcaacactgttcatttgga

SEQ ID NO: 254 - DNA, 20 bp, Artificial Sequence
  Description of Artificial Sequence: Synthetic primer
cccagctattcaggaggttg

SEQ ID NO: 255 - DNA, 20 bp, Artificial Sequence
  Description of Artificial Sequence: Synthetic primer
aacatgtgcgttttcaacca

SEQ ID NO: 256 - DNA, 20 bp, Artificial Sequence
  Description of Artificial Sequence: Synthetic primer
tgggtcagagaaaggattgc

SEQ ID NO: 257 - DNA, 20 bp, Artificial Sequence
  Description of Artificial Sequence: Synthetic primer
cagcaagccaccataccata

SEQ ID NO: 258 - DNA, 20 bp, Artificial Sequence
  Description of Artificial Sequence: Synthetic primer
tctacaccactgtgccaagc

SEQ ID NO: 259 - DNA, 20 bp, Artificial Sequence
  Description of Artificial Sequence: Synthetic primer
tctggcgaagtaacccaaac

SEQ ID NO: 260 - DNA, 20 bp, Artificial Sequence
  Description of Artificial Sequence: Synthetic primer
acaatggcaatcccaaattc

SEQ ID NO: 261 - DNA, 22 bp, Artificial Sequence
  Description of Artificial Sequence: Synthetic primer
aacatggtgaatccctgtctct

SEQ ID NO: 262 - DNA, 21 bp, Artificial Sequence
  Description of Artificial Sequence: Synthetic primer
tttttcctcccttaccacaga

SEQ ID NO: 263 - DNA, 20 bp, Artificial Sequence
  Description of Artificial Sequence: Synthetic primer
gataggatggggtggatgtg

SEQ ID NO: 264 - DNA, 20 bp, Artificial Sequence
  Description of Artificial Sequence: Synthetic primer
cacgcccagctaatttttgt

SEQ ID NO: 265 - DNA, 20 bp, Artificial Sequence
  Description of Artificial Sequence: Synthetic primer
attgatccatccgtctgtcc

SEQ ID NO: 266 - DNA, 20 bp, Artificial Sequence
  Description of Artificial Sequence: Synthetic primer
tttccaatgaccaagacgtg

SEQ ID NO: 267 - DNA, 20 bp, Artificial Sequence
  Description of Artificial Sequence: Synthetic primer
taatcgtcccattttgagca

SEQ ID NO: 268 - DNA, 20 bp, Artificial Sequence
  Description of Artificial Sequence: Synthetic primer
ggcaacacaagtgaaactgc

SEQ ID NO: 269 - DNA, 20 bp, Artificial Sequence
  Description of Artificial Sequence: Synthetic primer
aacagcctgcccaacatagt

SEQ ID NO: 270 - DNA, 20 bp, Artificial Sequence
  Description of Artificial Sequence: Synthetic primer
gccacagcacctgttcagta

SEQ ID NO: 271 - DNA, 22 bp, Artificial Sequence
  Description of Artificial Sequence: Synthetic primer
cctttgaaatcattcatcctgc

SEQ ID NO: 272 - DNA, 20 bp, Artificial Sequence
  Description of Artificial Sequence: Synthetic primer
attcacaccattgcactcca

SEQ ID NO: 273 - DNA, 21 bp, Artificial Sequence
  Description of Artificial Sequence: Synthetic primer
tctggtgaactgatccaaacc

SEQ ID NO: 274 - DNA, 21 bp, Artificial Sequence
  Description of Artificial Sequence: Synthetic primer
tctggtgaactgatccaaacc

SEQ ID NO: 275 - DNA, 20 bp, Artificial Sequence
  Description of Artificial Sequence: Synthetic primer
cagggtcaaaatcaccttcc

SEQ ID NO: 276 - DNA, 20 bp, Artificial Sequence
  Description of Artificial Sequence: Synthetic primer
gacccactggcattcaaatc

SEQ ID NO: 277 - DNA, 20 bp, Artificial Sequence
  Description of Artificial Sequence: Synthetic primer
ttggttttatgcctttcact

SEQ ID NO: 278 - DNA, 24 bp, Artificial Sequence
  Description of Artificial Sequence: Synthetic primer
catctaacatctttgtcatctacc

SEQ ID NO: 279 - DNA, 21 bp, Artificial Sequence
  Description of Artificial Sequence: Synthetic primer
catctacccaacatccatcta

SEQ ID NO: 280 - DNA, 20 bp, Artificial Sequence
  Description of Artificial Sequence: Synthetic primer
ttgcttttctgcttcccttc

SEQ ID NO: 281 - DNA, 20 bp, Artificial Sequence
  Description of Artificial Sequence: Synthetic primer
ggtctccaattccatccaga

SEQ ID NO: 282 - DNA, 20 bp, Artificial Sequence
  Description of Artificial Sequence: Synthetic primer
cccctgaatcaccagagttc

SEQ ID NO: 283 - DNA, 20 bp, Artificial Sequence
  Description of Artificial Sequence: Synthetic primer
gttgaagccctcaatctggt

SEQ ID NO: 284 - DNA, 20 bp, Artificial Sequence
  Description of Artificial Sequence: Synthetic primer
gaccgtgtactctggccaat

SEQ ID NO: 285 - DNA, 23 bp, Artificial Sequence
  Description of Artificial Sequence: Synthetic primer
ttctatctgttcatccatctagg

SEQ ID NO: 286 - DNA, 20 bp, Artificial Sequence
  Description of Artificial Sequence: Synthetic primer
caagggccaattatgtatgt

SEQ ID NO: 287 - DNA, 20 bp, Artificial Sequence
  Description of Artificial Sequence: Synthetic primer
ctgggcaacagagcaagatt

SEQ ID NO: 288 - DNA, 22 bp, Artificial Sequence
  Description of Artificial Sequence: Synthetic primer
gaggggagtgtagaaagaatgc

SEQ ID NO: 289 - DNA, 21 bp, Artificial Sequence
  Description of Artificial Sequence: Synthetic primer
cctgagctattttccctttgc

SEQ ID NO: 290 - DNA, 22 bp, Artificial Sequence
  Description of Artificial Sequence: Synthetic primer
tccatgttactgcaaaatacac

SEQ ID NO: 291 - DNA, 23 bp, Artificial Sequence
  Description of Artificial Sequence: Synthetic primer
aaccaaattcagggatgtactga

SEQ ID NO: 292 - DNA, 20 bp, Artificial Sequence
  Description of Artificial Sequence: Synthetic primer
gcctgggtaacaggagtgaa

SEQ ID NO: 293 - DNA, 20 bp, Artificial Sequence
  Description of Artificial Sequence: Synthetic primer
ccagcctgggtgacaaagta

SEQ ID NO: 294 - DNA, 20 bp, Artificial Sequence
  Description of Artificial Sequence: Synthetic primer
ccatagtgccgaggtcaagt

SEQ ID NO: 295 - DNA, 19 bp, Artificial Sequence
  Description of Artificial Sequence: Synthetic primer
ctgggccacagagtgagac

SEQ ID NO: 296 - DNA, 20 bp, Artificial Sequence
  Description of Artificial Sequence: Synthetic primer
tgctgtcacatcaccaatga

SEQ ID NO: 297 - DNA, 20 bp, Artificial Sequence
  Description of Artificial Sequence: Synthetic primer
ttttctgtgccaagcctaca

SEQ ID NO: 298 - DNA, 20 bp, Artificial Sequence
  Description of Artificial Sequence: Synthetic primer
ggtggtcagaaaatccctca

SEQ ID NO: 299 - DNA, 20 bp, Artificial Sequence
  Description of Artificial Sequence: Synthetic primer
agccaaggtcataccactgc

SEQ ID NO: 300 - DNA, 20 bp, Artificial Sequence
  Description of Artificial Sequence: Synthetic primer
gcctgatgccatctgaaaat

SEQ ID NO: 301 - DNA, 20 bp, Artificial Sequence
  Description of Artificial Sequence: Synthetic primer
aaacccaggaagcagtgttg

SEQ ID NO: 302 - DNA, 20 bp, Artificial Sequence
  Description of Artificial Sequence: Synthetic primer
ggaagctgaggaaggaggag

SEQ ID NO: 303 - DNA, 20 bp, Artificial Sequence
  Description of Artificial Sequence: Synthetic primer
gtggcagacaaaacccagtt

SEQ ID NO: 304 - DNA, 20 bp, Artificial Sequence
  Description of Artificial Sequence: Synthetic primer
tccatgggatatgatgagca

SEQ ID NO: 305 - DNA, 22 bp, Artificial Sequence
  Description of Artificial Sequence: Synthetic primer
gaactgtctacaatggctcacg

SEQ ID NO: 306 - DNA, 20 bp, Artificial Sequence
  Description of Artificial Sequence: Synthetic primer
agccttcagcgactgcttta

SEQ ID NO: 307 - DNA, 20 bp, Artificial Sequence
  Description of Artificial Sequence: Synthetic primer
ctaaggacgcctcccataca

SEQ ID NO: 308 - DNA, 20 bp, Artificial Sequence
  Description of Artificial Sequence: Synthetic primer
gggggagaaaaagtttggtg

SEQ ID NO: 309 - DNA, 20 bp, Artificial Sequence
  Description of Artificial Sequence: Synthetic primer
ggtggggcttccatattttt

SEQ ID NO: 310 - DNA, 20 bp, Artificial Sequence
  Description of Artificial Sequence: Synthetic primer
ggtggtggacatccgtaatc

SEQ ID NO: 311 - DNA, 20 bp, Artificial Sequence
  Description of Artificial Sequence: Synthetic primer
ttgggctgaggagttcaatc

SEQ ID NO: 312 - DNA, 22 bp, Artificial Sequence
  Description of Artificial Sequence: Synthetic primer
tcaatgcatgtttttctacgtg

SEQ ID NO: 313 - DNA, 20 bp, Artificial Sequence
  Description of Artificial Sequence: Synthetic primer
gaggcggaactttcagtgag

SEQ ID NO: 314 - DNA, 20 bp, Artificial Sequence
  Description of Artificial Sequence: Synthetic primer
gccagcagtagacccagact

SEQ ID NO: 315 - DNA, 19 bp, Artificial Sequence
  Description of Artificial Sequence: Synthetic primer
gcagtgagccgagatcagg

SEQ ID NO: 316 - DNA, 22 bp, Artificial Sequence
  Description of Artificial Sequence: Synthetic primer
gtagggtcttgaacagcatacg

SEQ ID NO: 317 - DNA, 20 bp, Artificial Sequence
  Description of Artificial Sequence: Synthetic primer
gcaggaaaattgcttgaacc

SEQ ID NO: 318 - DNA, 23 bp, Artificial Sequence
  Description of Artificial Sequence: Synthetic primer
tgcagaatgtatggtctttttga

SEQ ID NO: 319 - DNA, 23 bp, Artificial Sequence
  Description of Artificial Sequence: Synthetic primer
tggaagtattccactcacttgct

SEQ ID NO: 320 - DNA, 21 bp, Artificial Sequence
  Description of Artificial Sequence: Synthetic primer
cctaaagcgaagagaccatga

SEQ ID NO: 321 - DNA, 20 bp, Artificial Sequence
  Description of Artificial Sequence: Synthetic primer
gaatgcagaaccctcaagga

SEQ ID NO: 322 - DNA, 20 bp, Artificial Sequence
  Description of Artificial Sequence: Synthetic primer
gggaacatagtcgggctgta

SEQ ID NO: 323 - DNA, 20 bp, Artificial Sequence
  Description of Artificial Sequence: Synthetic primer
cttgaacccaggaagcagac

SEQ ID NO: 324 - DNA, 20 bp, Artificial Sequence
  Description of Artificial Sequence: Synthetic primer
gatgtgcctaatgccacaga

SEQ ID NO: 325 - DNA, 20 bp, Artificial Sequence
  Description of Artificial Sequence: Synthetic primer
tgttttcggttcctctgtcc

SEQ ID NO: 326 - DNA, 20 bp, Artificial Sequence
  Description of Artificial Sequence: Synthetic primer
ataaccgtgccctttactgc

SEQ ID NO: 327 - DNA, 20 bp, Artificial Sequence
  Description of Artificial Sequence: Synthetic primer
tacaggtgtgcaccatgagg

SEQ ID NO: 328 - DNA, 20 bp, Artificial Sequence
  Description of Artificial Sequence: Synthetic primer
cccccatgccagtaagaata

SEQ ID NO: 329 - DNA, 23 bp, Artificial Sequence
  Description of Artificial Sequence: Synthetic primer
atagaaggcaaattctttatcaa

SEQ ID NO: 330 - DNA, 20 bp, Artificial Sequence
  Description of Artificial Sequence: Synthetic primer
gtggcgatgttgtgagtgtt

SEQ ID NO: 331 - DNA, 21 bp, Artificial Sequence
  Description of Artificial Sequence: Synthetic primer
ggtcgaagaaggtgtcacaga

SEQ ID NO: 332 - DNA, 22 bp, Artificial Sequence
  Description of Artificial Sequence: Synthetic primer
ggcaaacagatagcaatttaca

SEQ ID NO: 333 - DNA, 20 bp, Artificial Sequence
  Description of Artificial Sequence: Synthetic primer
agcatgatgccttcagcttt

SEQ ID NO: 334 - DNA, 20 bp, Artificial Sequence
  Description of Artificial Sequence: Synthetic primer
cccatacccttggtgttgtc

SEQ ID NO: 335 - DNA, 20 bp, Artificial Sequence
  Description of Artificial Sequence: Synthetic primer
ggcgacagagcgagactcta

SEQ ID NO: 336 - DNA, 20 bp, Artificial Sequence
  Description of Artificial Sequence: Synthetic primer
tgacgagttaatgggtgcag

SEQ ID NO: 337 - DNA, 20 bp, Artificial Sequence
  Description of Artificial Sequence: Synthetic primer
gcccaaattaaaaggcacaa

SEQ ID NO: 338 - DNA, 20 bp, Artificial Sequence
  Description of Artificial Sequence: Synthetic primer
tccagcctcggtgataagag

SEQ ID NO: 339 - DNA, 21 bp, Artificial Sequence
  Description of Artificial Sequence: Synthetic primer
gcatctcaaatcctttgtgga

SEQ ID NO: 340 - DNA, 21 bp, Artificial Sequence
  Description of Artificial Sequence: Synthetic primer
tcatcacacatggcctaattg

SEQ ID NO: 341 - DNA, 20 bp, Artificial Sequence
  Description of Artificial Sequence: Synthetic primer
gcaagaccccatagcaaaag

SEQ ID NO: 342 - DNA, 20 bp, Artificial Sequence
  Description of Artificial Sequence: Synthetic primer
ctaggtgacagcgcaggatt

SEQ ID NO: 343 - DNA, 22 bp, Artificial Sequence
  Description of Artificial Sequence: Synthetic primer
gggattattacaattcaaggtc

SEQ ID NO: 344 - DNA, 20 bp, Artificial Sequence
  Description of Artificial Sequence: Synthetic primer
gcctttggacagagcaagac

SEQ ID NO: 345 - DNA, 20 bp, Artificial Sequence
  Description of Artificial Sequence: Synthetic primer
cactccagcctcggagatag

SEQ ID NO: 346 - DNA, 20 bp, Artificial Sequence
  Description of Artificial Sequence: Synthetic primer
ggccgttgcaaaataaactg

SEQ ID NO: 347 - DNA, 20 bp, Artificial Sequence
  Description of Artificial Sequence: Synthetic primer
ggcaacaagagcaaaactcc

SEQ ID NO: 348 - DNA, 22 bp, Artificial Sequence
  Description of Artificial Sequence: Synthetic primer
tcagaagcatgctagaacccta

SEQ ID NO: 349 - DNA, 20 bp, Artificial Sequence
  Description of Artificial Sequence: Synthetic primer
aagccagtcaaccaaacaca

SEQ ID NO: 350 - DNA, 20 bp, Artificial Sequence
  Description of Artificial Sequence: Synthetic primer
acaatttcccttggggctac

SEQ ID NO: 351 - DNA, 20 bp, Artificial Sequence
  Description of Artificial Sequence: Synthetic primer
tgggaaaaaccatgagatcc

SEQ ID NO: 352 - DNA, 20 bp, Artificial Sequence
  Description of Artificial Sequence: Synthetic primer
cttgagcccaggaagcatag

SEQ ID NO: 353 - DNA, 21 bp, Artificial Sequence
  Description of Artificial Sequence: Synthetic primer
cattgtgcacgtgtaccctaa

SEQ ID NO: 354 - DNA, 20 bp, Artificial Sequence
  Description of Artificial Sequence: Synthetic primer
aagccatgcctggttaaact

SEQ ID NO: 355 - DNA, 20 bp, Artificial Sequence
  Description of Artificial Sequence: Synthetic primer
tgacttcggggtagttccag

SEQ ID NO: 356 - DNA, 20 bp, Artificial Sequence
  Description of Artificial Sequence: Synthetic primer
ggttacgggtggcaatcata

SEQ ID NO: 357 - DNA, 28 bp, Artificial Sequence
  Description of Artificial Sequence: Synthetic primer
cctgccatctctatttatcttgcatata

SEQ ID NO: 358 - DNA, 20 bp, Artificial Sequence
  Description of Artificial Sequence: Synthetic primer
gacaaacccatcctgtctcc

SEQ ID NO: 359 - DNA, 20 bp, Artificial Sequence
  Description of Artificial Sequence: Synthetic primer
caacccaaacacttgcagaa

SEQ ID NO: 360 - DNA, 20 bp, Artificial Sequence
  Description of Artificial Sequence: Synthetic primer
tccatccatcaatccatcaa

SEQ ID NO: 361 - DNA, 20 bp, Artificial Sequence
  Description of Artificial Sequence: Synthetic primer
cccaaagtgctacccaccta

SEQ ID NO: 362 - DNA, 24 bp, Artificial Sequence
  Description of Artificial Sequence: Synthetic primer
ccaatgttactcactatgctgctt

SEQ ID NO: 363 - DNA, 21 bp, Artificial Sequence
  Description of Artificial Sequence: Synthetic primer
gccacagtgtgagaagtgtga

SEQ ID NO: 364 - DNA, 20 bp, Artificial Sequence
  Description of Artificial Sequence: Synthetic primer
cccagacaacagagcaaaac

SEQ ID NO: 365 - DNA, 20 bp, Artificial Sequence
  Description of Artificial Sequence: Synthetic primer
tgacgagttagtgggtgcag

SEQ ID NO: 366 - DNA, 20 bp, Artificial Sequence
  Description of Artificial Sequence: Synthetic primer
gtggagcctgcttaaaggaa

SEQ ID NO: 367 - DNA, 20 bp, Artificial Sequence
  Description of Artificial Sequence: Synthetic primer
gcagtgagctgagatggtga

SEQ ID NO: 368 - DNA, 22 bp, Artificial Sequence
  Description of Artificial Sequence: Synthetic primer
ttgaatgccaagttatgtagca

SEQ ID NO: 369 - DNA, 20 bp, Artificial Sequence
  Description of Artificial Sequence: Synthetic primer
ccatgttttgggacattcct

SEQ ID NO: 370 - DNA, 23 bp, Artificial Sequence
  Description of Artificial Sequence: Synthetic primer
ttctaggaagattagccacaaca

SEQ ID NO: 371 - DNA, 20 bp, Artificial Sequence
  Description of Artificial Sequence: Synthetic primer
acagagcaggattccatcta

SEQ ID NO: 372 - DNA, 20 bp, Artificial Sequence
  Description of Artificial Sequence: Synthetic primer
acagagcaggattccatcta

SEQ ID NO: 373 - DNA, 20 bp, Artificial Sequence
  Description of Artificial Sequence: Synthetic primer
ccatgatggaacaattgcag

SEQ ID NO: 374 - DNA, 21 bp, Artificial Sequence
  Description of Artificial Sequence: Synthetic primer
cacatcaagttgcctgtttca

SEQ ID NO: 375 - DNA, 20 bp, Artificial Sequence
  Description of Artificial Sequence: Synthetic primer
tccaccaaaattccatgaca

SEQ ID NO: 376 - DNA, 20 bp, Artificial Sequence
  Description of Artificial Sequence: Synthetic primer
gcggctagggtagaatccat

SEQ ID NO: 377 - DNA, 18 bp, Artificial Sequence
  Description of Artificial Sequence: Synthetic primer
cagatcgcaaccactgcg

SEQ ID NO: 378 - DNA, 22 bp, Artificial Sequence
  Description of Artificial Sequence: Synthetic primer
agtaattctggaggtaaaatgg

SEQ ID NO: 379 - DNA, 22 bp, Artificial Sequence
  Description of Artificial Sequence: Synthetic primer
ggtgacaagacgagactttgtg

SEQ ID NO: 380 - DNA, 21 bp, Artificial Sequence
  Description of Artificial Sequence: Synthetic primer
ggagatgaatgaatggatgga

SEQ ID NO: 381 - DNA, 20 bp, Artificial Sequence
  Description of Artificial Sequence: Synthetic primer
ttctctctccccctcctctc

SEQ ID NO: 382 - DNA, 20 bp, Artificial Sequence
  Description of Artificial Sequence: Synthetic primer
gcaatccaacttcagccaat

SEQ ID NO: 383 - DNA, 22 bp, Artificial Sequence
  Description of Artificial Sequence: Synthetic primer
aagttgcagtgagcgaagattg

SEQ ID NO: 384 - DNA, 21 bp, Artificial Sequence
  Description of Artificial Sequence: Synthetic primer
ccccaagtccccaaagtgtgt

SEQ ID NO: 385 - DNA, 20 bp, Artificial Sequence
  Description of Artificial Sequence: Synthetic primer
tcattggccacctgacatta

SEQ ID NO: 386 - DNA, 20 bp, Artificial Sequence
  Description of Artificial Sequence: Synthetic primer
tcacgttgttcaagggtcaa

SEQ ID NO: 387 - DNA, 22 bp, Artificial Sequence
  Description of Artificial Sequence: Synthetic primer
agttaagagccccaccttcctg

SEQ ID NO: 388 - DNA, 26 bp, Artificial Sequence
  Description of Artificial Sequence: Synthetic primer
aaatgtatggccaacatagcaaaacc

SEQ ID NO: 389 - DNA, 20 bp, Artificial Sequence
  Description of Artificial Sequence: Synthetic primer
ggtcacagcatggcttggtt

SEQ ID NO: 390 - DNA, 21 bp, Artificial Sequence
  Description of Artificial Sequence: Synthetic primer
ccattgcactctaggttggac

SEQ ID NO: 391 - DNA, 23 bp, Artificial Sequence
  Description of Artificial Sequence: Synthetic primer
tggaatatgatgcagctgtttgt

SEQ ID NO: 392 - DNA, 22 bp, Artificial Sequence
  Description of Artificial Sequence: Synthetic primer
gtggtgttctgatgaggataat

SEQ ID NO: 393 - DNA, 22 bp, Artificial Sequence
  Description of Artificial Sequence: Synthetic primer
ctaaaagtatggatattcttcg

SEQ ID NO: 394 - DNA, 20 bp, Artificial Sequence
  Description of Artificial Sequence: Synthetic primer
gttctttggccctgcattta

SEQ ID NO: 395 - DNA, 18 bp, Artificial Sequence
  Description of Artificial Sequence: Synthetic primer
ggggtggaaacgagtgtt

SEQ ID NO: 396 - DNA, 22 bp, Artificial Sequence
  Description of Artificial Sequence: Synthetic primer
ttgagcaacagagcaagactta

SEQ ID NO: 397 - DNA, 25 bp, Artificial Sequence
  Description of Artificial Sequence: Synthetic primer
tctatcctctgcctatcatttatta

SEQ ID NO: 398 - DNA, 25 bp, Artificial Sequence
  Description of Artificial Sequence: Synthetic primer
ttcaggtaaatctgtccagtagtga

SEQ ID NO: 399 - DNA, 20 bp, Artificial Sequence
  Description of Artificial Sequence: Synthetic primer
ccagcctgagcaagagagta

SEQ ID NO: 400 - DNA, 22 bp, Artificial Sequence
  Description of Artificial Sequence: Synthetic primer
atgaggttgtgtgacttgactg

SEQ ID NO: 401 - DNA, 22 bp, Artificial Sequence
  Description of Artificial Sequence: Synthetic primer
cctgggtaacagagagactctt

SEQ ID NO: 402 - DNA, 20 bp, Artificial Sequence
  Description of Artificial Sequence: Synthetic primer
gggggaagatgacaatgatg

SEQ ID NO: 403 - DNA, 20 bp, Artificial Sequence
  Description of Artificial Sequence: Synthetic primer
ccccagctggtaaaatgagt

SEQ ID NO: 404 - DNA, 23 bp, Artificial Sequence
  Description of Artificial Sequence: Synthetic primer
tggctgtaaaacaaatatcagca

SEQ ID NO: 405 - DNA, 20 bp, Artificial Sequence
  Description of Artificial Sequence: Synthetic primer
gaggcactgtgttcagcaaa

SEQ ID NO: 406 - DNA, 23 bp, Artificial Sequence
  Description of Artificial Sequence: Synthetic primer
cctcttttctttgctggttcctt

SEQ ID NO: 407 - DNA, 23 bp, Artificial Sequence
  Description of Artificial Sequence: Synthetic primer
ggcatctaggtttactgtgagga

SEQ ID NO: 408 - DNA, 20 bp, Artificial Sequence
  Description of Artificial Sequence: Synthetic primer
cccacagaaagatgttgagg

SEQ ID NO: 409 - DNA, 22 bp, Artificial Sequence
  Description of Artificial Sequence: Synthetic primer
agctgggaagtactcaatgctc

SEQ ID NO: 410 - DNA, 20 bp, Artificial Sequence
  Description of Artificial Sequence: Synthetic primer
aagtgaatcgagtgcctagc

SEQ ID NO: 411 - DNA, 23 bp, Artificial Sequence
  Description of Artificial Sequence: Synthetic primer
tcaggataagctagcagtctatg

SEQ ID NO: 412 - DNA, 20 bp, Artificial Sequence
  Description of Artificial Sequence: Synthetic primer
cagcactccaaaatgacaga

SEQ ID NO: 413 - DNA, 20 bp, Artificial Sequence
  Description of Artificial Sequence: Synthetic primer
acagctcaccagaaggttgc

SEQ ID NO: 414 - DNA, 20 bp, Artificial Sequence
  Description of Artificial Sequence: Synthetic primer
cctggttgacaaagccagat

SEQ ID NO: 415 - DNA, 20 bp, Artificial Sequence
  Description of Artificial Sequence: Synthetic primer
aaaaattagctgggcctggt

SEQ ID NO: 416 - DNA, 20 bp, Artificial Sequence
  Description of Artificial Sequence: Synthetic primer
cctgggcaacagagaaagac

SEQ ID NO: 417 - DNA, 20 bp, Artificial Sequence
  Description of Artificial Sequence: Synthetic primer
taccctggtccacttcaacc

SEQ ID NO: 418 - DNA, 20 bp, Artificial Sequence
  Description of Artificial Sequence: Synthetic primer
aaaattagccgagcatggtg

SEQ ID NO: 419 - DNA, 19 bp, Artificial Sequence
  Description of Artificial Sequence: Synthetic primer
gcagagcttgcactgagct

SEQ ID NO: 420 - DNA, 23 bp, Artificial Sequence
  Description of Artificial Sequence: Synthetic primer
ggagaaaattcaatgcagatacc

SEQ ID NO: 421 - DNA, 20 bp, Artificial Sequence
  Description of Artificial Sequence: Synthetic primer
agtaggggtcaggcacaatg

SEQ ID NO: 422 - DNA, 20 bp, Artificial Sequence
  Description of Artificial Sequence: Synthetic primer
ccctgggattataggcatga

SEQ ID NO: 423 - DNA, 22 bp, Artificial Sequence
  Description of Artificial Sequence: Synthetic primer
aacaaacctgcatgttcttcaa

SEQ ID NO: 424 - DNA, 21 bp, Artificial Sequence
  Description of Artificial Sequence: Synthetic primer
gccagaaagtgtgagtcatcc

SEQ ID NO: 425 - DNA, 21 bp, Artificial Sequence
  Description of Artificial Sequence: Synthetic primer
gcatgttgtgcacatgtaacc

SEQ ID NO: 426 - DNA, 20 bp, Artificial Sequence
  Description of Artificial Sequence: Synthetic primer
ggaggaagaggttgcaatga

SEQ ID NO: 427 - DNA, 20 bp, Artificial Sequence
  Description of Artificial Sequence: Synthetic primer
tgtgcttttggagtttggag

SEQ ID NO: 428 - DNA, 19 bp, Artificial Sequence
  Description of Artificial Sequence: Synthetic primer
ggcaacagagcaaccctct

SEQ ID NO: 429 - DNA, 21 bp, Artificial Sequence
  Description of Artificial Sequence: Synthetic primer
tcgagtcagttcaccagaagg

SEQ ID NO: 430 - DNA, 22 bp, Artificial Sequence
  Description of Artificial Sequence: Synthetic primer
gaacaaataaggtgggatggat

SEQ ID NO: 431 - DNA, 20 bp, Artificial Sequence
  Description of Artificial Sequence: Synthetic primer
tgtccccagggctttttaat

SEQ ID NO: 432 - DNA, 23 bp, Artificial Sequence
  Description of Artificial Sequence: Synthetic primer
tctggagaagacagaacttgtca

SEQ ID NO: 433 - DNA, 23 bp, Artificial Sequence
  Description of Artificial Sequence: Synthetic primer
tgtgaattccccttctacatctc

SEQ ID NO: 434 - DNA, 21 bp, Artificial Sequence
  Description of Artificial Sequence: Synthetic primer
gggaggaataaaggaaggttg

SEQ ID NO: 435 - DNA, 20 bp, Artificial Sequence
  Description of Artificial Sequence: Synthetic primer
gttggatgaagggagagcag

SEQ ID NO: 436 - DNA, 20 bp, Artificial Sequence
  Description of Artificial Sequence: Synthetic primer
cgaacctgcaaattgttcac

SEQ ID NO: 437 - DNA, 20 bp, Artificial Sequence
  Description of Artificial Sequence: Synthetic primer
tgcaatcccaaactcagaaa

SEQ ID NO: 438 - DNA, 21 bp, Artificial Sequence
  Description of Artificial Sequence: Synthetic primer
tcagctcttaccatgggtgat

SEQ ID NO: 439 - DNA, 19 bp, Artificial Sequence
  Description of Artificial Sequence: Synthetic primer
accatcatgccctgcaata

SEQ ID NO: 440 - DNA, 20 bp, Artificial Sequence
  Description of Artificial Sequence: Synthetic primer
gctgggagtgagaccctgta

SEQ ID NO: 441 - DNA, 20 bp, Artificial Sequence
  Description of Artificial Sequence: Synthetic primer
tcataaacagagggttctgg

SEQ ID NO: 442 - DNA, 22 bp, Artificial Sequence
  Description of Artificial Sequence: Synthetic primer
ccatctgtttatcttcccatca

SEQ ID NO: 443 - DNA, 20 bp, Artificial Sequence
  Description of Artificial Sequence: Synthetic primer
gggttacttcgccagaaggt

SEQ ID NO: 444 - DNA, 20 bp, Artificial Sequence
  Description of Artificial Sequence: Synthetic primer
gggttacttcgccagaaggt

SEQ ID NO: 445 - DNA, 19 bp, Artificial Sequence
  Description of Artificial Sequence: Synthetic primer
ctgcgggacaatgaaacac

SEQ ID NO: 446 - DNA, 21 bp, Artificial Sequence
  Description of Artificial Sequence: Synthetic primer
tgctccctttctttgtagacg

SEQ ID NO: 447 - DNA, 20 bp, Artificial Sequence
  Description of Artificial Sequence: Synthetic primer
taggtgacagagcaggattc

SEQ ID NO: 448 - DNA, 22 bp, Artificial Sequence
  Description of Artificial Sequence: Synthetic primer
tgatcagttcttaactcaacca

SEQ ID NO: 449 - DNA, 25 bp, Artificial Sequence
  Description of Artificial Sequence: Synthetic primer
gacaaagatgttagatgaatagaca

SEQ ID NO: 450 - DNA, 20 bp, Artificial Sequence
  Description of Artificial Sequence: Synthetic primer
atcgcattcccctctcctac

SEQ ID NO: 451 - DNA, 20 bp, Artificial Sequence
  Description of Artificial Sequence: Synthetic primer
tggaacatgcccattaatca

SEQ ID NO: 452 - DNA, 20 bp, Artificial Sequence
  Description of Artificial Sequence: Synthetic primer
aaccagcccaaatacccatc

SEQ ID NO: 453 - DNA, 20 bp, Artificial Sequence
  Description of Artificial Sequence: Synthetic primer
ggtgcagatctcccaaattc

SEQ ID NO: 454 - DNA, 20 bp, Artificial Sequence
  Description of Artificial Sequence: Synthetic primer
caggaggctagctcaggaga

SEQ ID NO: 455 - DNA, 20 bp, Artificial Sequence
  Description of Artificial Sequence: Synthetic primer
acctttaagaagccttcacc

SEQ ID NO: 456 - DNA, 20 bp, Artificial Sequence
  Description of Artificial Sequence: Synthetic primer
tgatcttcctggtcactttt

SEQ ID NO: 457 - DNA, 20 bp, Artificial Sequence
  Description of Artificial Sequence: Synthetic primer
aatgctggccaaaacaaagt

SEQ ID NO: 458 - DNA, 20 bp, Artificial Sequence
  Description of Artificial Sequence: Synthetic primer
gatccaagatggtgccattg

SEQ ID NO: 459 - DNA, 20 bp, Artificial Sequence
  Description of Artificial Sequence: Synthetic primer
tgcagtacatcctggggaat

SEQ ID NO: 460 - DNA, 20 bp, Artificial Sequence
  Description of Artificial Sequence: Synthetic primer
tgacagagcataaacgtgtc

SEQ ID NO: 461 - DNA, 20 bp, Artificial Sequence
  Description of Artificial Sequence: Synthetic primer
gtccccttttccatttgtga

SEQ ID NO: 462 - DNA, 20 bp, Artificial Sequence
  Description of Artificial Sequence: Synthetic primer
agctgaaaactgtgctgctg

SEQ ID NO: 463 - DNA, 20 bp, Artificial Sequence
  Description of Artificial Sequence: Synthetic primer
aaagttcctcccagttgcac

SEQ ID NO: 464 - DNA, 19 bp, Artificial Sequence
  Description of Artificial Sequence: Synthetic primer
aacacctgatgcctggttg

SEQ ID NO: 465 - DNA, 20 bp, Artificial Sequence
  Description of Artificial Sequence: Synthetic primer
gggccagtctttgcaatatc

SEQ ID NO: 466 - DNA, 20 bp, Artificial Sequence
  Description of Artificial Sequence: Synthetic primer
tttggttgctgaagcattga

SEQ ID NO: 467 - DNA, 21 bp, Artificial Sequence
  Description of Artificial Sequence: Synthetic primer
tctaatgcaccttgagggatg

SEQ ID NO: 468 - DNA, 20 bp, Artificial Sequence
  Description of Artificial Sequence: Synthetic primer
gcaggccaatattcaccatt

SEQ ID NO: 469 - DNA, 20 bp, Artificial Sequence
  Description of Artificial Sequence: Synthetic primer
tcggtgaaggcaccaataat

SEQ ID NO: 470 - DNA, 20 bp, Artificial Sequence
  Description of Artificial Sequence: Synthetic primer
tgatcccaacaactgcactc

SEQ ID NO: 471 - DNA, 20 bp, Artificial Sequence
  Description of Artificial Sequence: Synthetic primer
cctggctcagcacatgaata

SEQ ID NO: 472 - DNA, 20 bp, Artificial Sequence
  Description of Artificial Sequence: Synthetic primer
ttatgaccgggatcaagtgc

SEQ ID NO: 473 - DNA, 20 bp, Artificial Sequence
  Description of Artificial Sequence: Synthetic primer
ttgaaaagggatgggactca

SEQ ID NO: 474 - DNA, 20 bp, Artificial Sequence
  Description of Artificial Sequence: Synthetic primer
ggcagcctgtaggacagaga

SEQ ID NO: 475 - DNA, 24 bp, Artificial Sequence
  Description of Artificial Sequence: Synthetic primer
tcagcatagtcaagaaaccagaca

SEQ ID NO: 476 - DNA, 20 bp, Artificial Sequence
  Description of Artificial Sequence: Synthetic primer
agctgagatcatcccattgc

SEQ ID NO: 477 - DNA, 21 bp, Artificial Sequence
  Description of Artificial Sequence: Synthetic primer
ctcattccctatggtttgcac

SEQ ID NO: 478 - DNA, 20 bp, Artificial Sequence
  Description of Artificial Sequence: Synthetic primer
aaaaatggggaggtggaaat

SEQ ID NO: 479 - DNA, 21 bp, Artificial Sequence
  Description of Artificial Sequence: Synthetic primer
aatgtagacgacgggttgatg

SEQ ID NO: 480 - DNA, 20 bp, Artificial Sequence
  Description of Artificial Sequence: Synthetic primer
agtaatgggatgctgggtca

SEQ ID NO: 481 - DNA, 20 bp, Artificial Sequence
  Description of Artificial Sequence: Synthetic primer
ggcagtctcatttcctggag

SEQ ID NO: 482 - DNA, 20 bp, Artificial Sequence
  Description of Artificial Sequence: Synthetic primer
ggaggatggtttgaacctga

SEQ ID NO: 483 - DNA, 20 bp, Artificial Sequence
  Description of Artificial Sequence: Synthetic primer
gcttcaacaaccctggacat

SEQ ID NO: 484 - DNA, 20 bp, Artificial Sequence
  Description of Artificial Sequence: Synthetic primer
aggcagaggttgcagtgagt

SEQ ID NO: 485 - DNA, 21 bp, Artificial Sequence
  Description of Artificial Sequence: Synthetic primer
ggagcaaacactgcaatttcc

SEQ ID NO: 486 - DNA, 19 bp, Artificial Sequence
  Description of Artificial Sequence: Synthetic primer
cgagccaagctgctgttat

SEQ ID NO: 487 - DNA, 21 bp, Artificial Sequence
  Description of Artificial Sequence: Synthetic primer
cctcatccaatagctcttcct

SEQ ID NO: 488 - DNA, 20 bp, Artificial Sequence
  Description of Artificial Sequence: Synthetic primer
ctgccagtctattgcccttc

SEQ ID NO: 489 - DNA, 20 bp, Artificial Sequence
  Description of Artificial Sequence: Synthetic primer
ctcaagtggggaagtcaagg

SEQ ID NO: 490 - DNA, 21 bp, Artificial Sequence
  Description of Artificial Sequence: Synthetic primer
tgaaggccaaagagtgaaaga

SEQ ID NO: 491 - DNA, 20 bp, Artificial Sequence
  Description of Artificial Sequence: Synthetic primer
agcctgggtgacagaaacac

SEQ ID NO: 492 - DNA, 20 bp, Artificial Sequence
  Description of Artificial Sequence: Synthetic primer
gggtgacagagcaagaatcc

SEQ ID NO: 493 - DNA, 20 bp, Artificial Sequence
  Description of Artificial Sequence: Synthetic primer
ttatgcccaagtgacactgc

SEQ ID NO: 494 - DNA, 20 bp, Artificial Sequence
  Description of Artificial Sequence: Synthetic primer
ccctggtgttaatcgtgtcc

SEQ ID NO: 495 - DNA, 20 bp, Artificial Sequence
  Description of Artificial Sequence: Synthetic primer
aggggaacaacacacactgg

SEQ ID NO: 496 - DNA, 21 bp, Artificial Sequence
  Description of Artificial Sequence: Synthetic primer
ttttgacaagcccaaagttct

SEQ ID NO: 497 - DNA, 20 bp, Artificial Sequence
  Description of Artificial Sequence: Synthetic primer
cttggcaacatagcagatcc

SEQ ID NO: 498 - DNA, 20 bp, Artificial Sequence
  Description of Artificial Sequence: Synthetic primer
tgagggaaggcaaaagaaaa

SEQ ID NO: 499 - DNA, 20 bp, Artificial Sequence
  Description of Artificial Sequence: Synthetic primer
aaagttaatgacgccttgtc

SEQ ID NO: 500 - DNA, 20 bp, Artificial Sequence
  Description of Artificial Sequence: Synthetic primer
gccaccaaaaggttttcaga

SEQ ID NO: 501 - DNA, 21 bp, Artificial Sequence
  Description of Artificial Sequence: Synthetic primer
tgattctgctaattcccatgc

SEQ ID NO: 502 - DNA, 19 bp, Artificial Sequence
  Description of Artificial Sequence: Synthetic primer
ttgttctgcccagcagtat

SEQ ID NO: 503 - DNA, 20 bp, Artificial Sequence
  Description of Artificial Sequence: Synthetic primer
ggattggggagtgatagcat

SEQ ID NO: 504 - DNA, 20 bp, Artificial Sequence
  Description of Artificial Sequence: Synthetic primer
gagggctatgggagggatag

SEQ ID NO: 505 - DNA, 20 bp, Artificial Sequence
  Description of Artificial Sequence: Synthetic primer
ggcatgtgagttgaggaaca

SEQ ID NO: 506 - DNA, 22 bp, Artificial Sequence
  Description of Artificial Sequence: Synthetic primer
tgagtttgctcctctagctttc

SEQ ID NO: 507 - DNA, 20 bp, Artificial Sequence
  Description of Artificial Sequence: Synthetic primer
tgacgagttagtgggtgcag

SEQ ID NO: 508 - DNA, 20 bp, Artificial Sequence
  Description of Artificial Sequence: Synthetic primer
ggctgaagtgggttgtgtta

SEQ ID NO: 509 - DNA, 20 bp, Artificial Sequence
  Description of Artificial Sequence: Synthetic primer
tccacctgcttttctcttca

SEQ ID NO: 510 - DNA, 21 bp, Artificial Sequence
  Description of Artificial Sequence: Synthetic primer
ggcaagtcacatgcattacaa

SEQ ID NO: 511 - DNA, 23 bp, Artificial Sequence
  Description of Artificial Sequence: Synthetic primer
aagaagaattttgggacatgttt

SEQ ID NO: 512 - DNA, 21 bp, Artificial Sequence
  Description of Artificial Sequence: Synthetic primer
ggataatgagcaaatggcaag

SEQ ID NO: 513 - DNA, 20 bp, Artificial Sequence
  Description of Artificial Sequence: Synthetic primer
tatgggtaaatggcaaaagt

SEQ ID NO: 514 - DNA, 20 bp, Artificial Sequence
  Description of Artificial Sequence: Synthetic primer
agccatggaaagctgtgagt

SEQ ID NO: 515 - DNA, 20 bp, Artificial Sequence
  Description of Artificial Sequence: Synthetic primer
gcgctctgtggacattatca

SEQ ID NO: 516 - DNA, 20 bp, Artificial Sequence
  Description of Artificial Sequence: Synthetic primer
tctgggcaacagaaggagac

SEQ ID NO: 517 - DNA, 20 bp, Artificial Sequence
  Description of Artificial Sequence: Synthetic primer
ccaccagggaagtgtctttc

SEQ ID NO: 518 - DNA, 22 bp, Artificial Sequence
  Description of Artificial Sequence: Synthetic primer
ttgctccttacagaagaggtga

SEQ ID NO: 519 - DNA, 20 bp, Artificial Sequence
  Description of Artificial Sequence: Synthetic primer
tgctggggttgaaggtaaaa

SEQ ID NO: 520 - DNA, 20 bp, Artificial Sequence
  Description of Artificial Sequence: Synthetic primer
catggtggtaggcacctgta

SEQ ID NO: 521 - DNA, 20 bp, Artificial Sequence
  Description of Artificial Sequence: Synthetic primer
tagggtcaagcccgttcata

SEQ ID NO: 522 - DNA, 20 bp, Artificial Sequence
  Description of Artificial Sequence: Synthetic primer
ccacacgatgcaattttgtc

SEQ ID NO: 523 - DNA, 20 bp, Artificial Sequence
  Description of Artificial Sequence: Synthetic primer
aaagggttgtgctgcatgat

SEQ ID NO: 524 - DNA, 21 bp, Artificial Sequence
  Description of Artificial Sequence: Synthetic primer
tgtaaccaaacaccacccatt

SEQ ID NO: 525 - DNA, 20 bp, Artificial Sequence
  Description of Artificial Sequence: Synthetic primer
cctgggcaaaagagtgagac

SEQ ID NO: 526 - DNA, 20 bp, Artificial Sequence
  Description of Artificial Sequence: Synthetic primer
actgccagactcacacatgg

SEQ ID NO: 527 - DNA, 24 bp, Artificial Sequence
  Description of Artificial Sequence: Synthetic primer
ataaatggagatagtgggtggatt

SEQ ID NO: 528 - DNA, 88 bp, Homo sapiens
  modified_base (69)..(76): a, c, t, g, unknown or other
ggatggatggatggatggatggatggatggatggatggatggatggatggatagatggatggatggatnnnnnnnnggacggacggac

SEQ ID NO: 529 - DNA, 92 bp, Homo sapiens
  modified_base (73)..(80): a, c, t, g, unknown or other
ggatggatggatggatggatggatggatggatggatggatggatggatggatggatagatggatggatggatnnnnnnnnggacggacggac

SEQ ID NO: 530 - DNA, 36 bp, Homo sapiens
aataataataataataataataataataataataat

SEQ ID NO: 531 - DNA, 39 bp, Homo sapiens
aataataataataataataataataataataataataat

SEQ ID NO: 532 - DNA, 42 bp, Homo sapiens
aataataataataataataataataataataataataataat

SEQ ID NO: 533 - DNA, 39 bp, Homo sapiens; identical to SEQ ID NO: 531

SEQ ID NO: 534 - DNA, 39 bp, Homo sapiens; identical to SEQ ID NO: 531

SEQ ID NO: 535 - DNA, 36 bp, Homo sapiens; identical to SEQ ID NO: 530

SEQ ID NO: 536 - DNA, 45 bp, Homo sapiens
aataataataataataataataataataataataataataataat

SEQ ID NO: 537 - DNA, 39 bp, Homo sapiens; identical to SEQ ID NO: 531

SEQ ID NO: 538 - DNA, 42 bp, Homo sapiens; identical to SEQ ID NO: 532

SEQ ID NO: 539 - DNA, 39 bp, Homo sapiens; identical to SEQ ID NO: 531

SEQ ID NO: 540 - DNA, 33 bp, Homo sapiens; identical to SEQ ID NO: 1

SEQ ID NO: 541 - DNA, 36 bp, Homo sapiens; identical to SEQ ID NO: 530

SEQ ID NO: 542 - DNA, 42 bp, Homo sapiens; identical to SEQ ID NO: 532

SEQ ID NO: 543 - DNA, 39 bp, Homo sapiens; identical to SEQ ID NO: 531

SEQ ID NO: 544 - DNA, 42 bp, Homo sapiens; identical to SEQ ID NO: 532

SEQ ID NO: 545 - DNA, 45 bp, Homo sapiens; identical to SEQ ID NO: 536

SEQ ID NO: 546 - DNA, 42 bp, Homo sapiens; identical to SEQ ID NO: 532

SEQ ID NO: 547 - DNA, 39 bp, Homo sapiens; identical to SEQ ID NO: 531

SEQ ID NO: 548 - DNA, 42 bp, Homo sapiens; identical to SEQ ID NO: 532

SEQ ID NO: 549 - DNA, 39 bp, Homo sapiens; identical to SEQ ID NO: 531

SEQ ID NO: 550 - DNA, 182 bp, Homo sapiens
  modified_base (73)..(90): a, c, t, g, unknown or other
  modified_base (119)..(126): a, c, t, g, unknown or other
  modified_base (139)..(170): a, c, t, g, unknown or other
cttccttccttccttccttccttcctttctttctttctttctttctttctttctttctttctttctttctttnnnnnnnnnnnnnnnnnncttccttccttctttccttccttccttcnnnnnnnncttccttccttcnnnnnnnnnnnnnnnnnnnnnnnnnnnnnnnncttccttccttc

SEQ ID NO: 551 - DNA, 186 bp, Homo sapiens
  modified_base (77)..(94): a, c, t, g, unknown or other
  modified_base (123)..(130): a, c, t, g, unknown or other
  modified_base (143)..(174): a, c, t, g, unknown or other
cttccttccttccttccttccttcctttctttctttctttctttctttctttctttctttctttctttctttctttnnnnnnnnnnnnnnnnnncttccttccttctttccttccttccttcnnnnnnnncttccttccttcnnnnnnnnnnnnnnnnnnnnnnnnnnnnnnnncttccttccttc

SEQ ID NO: 552 - DNA, 190 bp, Homo sapiens
  modified_base (81)..(98): a, c, t, g, unknown or other
  modified_base (127)..(134): a, c, t, g, unknown or other
  modified_base (147)..(178): a, c, t, g, unknown or other
cttccttccttccttccttccttcctttctttctttctttctttctttctttctttctttctttctttctttctttctttnnnnnnnnnnnnnnnnnncttccttccttctttccttccttccttcnnnnnnnncttccttccttcnnnnnnnnnnnnnnnnnnnnnnnnnnnnnnnncttccttccttc

SEQ ID NO: 553 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 554 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 555 - DNA, 186 bp, Homo sapiens; identical to SEQ ID NO: 551
  modified_base (77)..(94): a, c, t, g, unknown or other
  modified_base (123)..(130): a, c, t, g, unknown or other
  modified_base (143)..(174): a, c, t, g, unknown or other

SEQ ID NO: 556 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 557 - DNA, 186 bp, Homo sapiens; identical to SEQ ID NO: 551
  modified_base (77)..(94): a, c, t, g, unknown or other
  modified_base (123)..(130): a, c, t, g, unknown or other
  modified_base (143)..(174): a, c, t, g, unknown or other

SEQ ID NO: 558 - DNA, 178 bp, Homo sapiens
  modified_base (69)..(86): a, c, t, g, unknown or other
  modified_base (115)..(122): a, c, t, g, unknown or other
  modified_base (135)..(166): a, c, t, g, unknown or other
cttccttccttccttccttccttcctttctttctttctttctttctttctttctttctttctttctttnnnnnnnnnnnnnnnnnncttccttccttctttccttccttccttcnnnnnnnncttccttccttcnnnnnnnnnnnnnnnnnnnnnnnnnnnnnnnncttccttccttc

SEQ ID NO: 559 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 560 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 561 - DNA, 178 bp, Homo sapiens; identical to SEQ ID NO: 558
  modified_base (69)..(86): a, c, t, g, unknown or other
  modified_base (115)..(122): a, c, t, g, unknown or other
  modified_base (135)..(166): a, c, t, g, unknown or other

SEQ ID NO: 562 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 563 - DNA, 186 bp, Homo sapiens; identical to SEQ ID NO: 551
  modified_base (77)..(94): a, c, t, g, unknown or other
  modified_base (123)..(130): a, c, t, g, unknown or other
  modified_base (143)..(174): a, c, t, g, unknown or other

SEQ ID NO: 564 - DNA, 186 bp, Homo sapiens; identical to SEQ ID NO: 551
  modified_base (77)..(94): a, c, t, g, unknown or other
  modified_base (123)..(130): a, c, t, g, unknown or other
  modified_base (143)..(174): a, c, t, g, unknown or other

SEQ ID NO: 565 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 566 - DNA, 186 bp, Homo sapiens; identical to SEQ ID NO: 551
  modified_base (77)..(94): a, c, t, g, unknown or other
  modified_base (123)..(130): a, c, t, g, unknown or other
  modified_base (143)..(174): a, c, t, g, unknown or other

SEQ ID NO: 567 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 568 - DNA, 186 bp, Homo sapiens; identical to SEQ ID NO: 551
  modified_base (77)..(94): a, c, t, g, unknown or other
  modified_base (123)..(130): a, c, t, g, unknown or other
  modified_base (143)..(174): a, c, t, g, unknown or other

SEQ ID NO: 569 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 570 - DNA, 190 bp, Homo sapiens; identical to SEQ ID NO: 552
  modified_base (81)..(98): a, c, t, g, unknown or other
  modified_base (127)..(134): a, c, t, g, unknown or other
  modified_base (147)..(178): a, c, t, g, unknown or other

SEQ ID NO: 571 - DNA, 182 bp, Homo sapiens; identical to SEQ ID NO: 550
  modified_base (73)..(90): a, c, t, g, unknown or other
  modified_base (119)..(126): a, c, t, g, unknown or other
  modified_base (139)..(170): a, c, t, g, unknown or other

SEQ ID NO: 572 - DNA, 44 bp, Homo sapiens
tttatttatttatttatttatttatttatttatttatttattta

SEQ ID NO: 573 - DNA, 40 bp, Homo sapiens
tttatttatttatttatttatttatttatttatttattta

SEQ ID NO: 574 - DNA, 95 bp, Homo sapiens
aagaagaagaagaaaagaagaagaagaagaagaagaagaagaagaagaagaagaagaagaagaagaagaagaagaagaagaagaagaagaagcag

SEQ ID NO: 575 - DNA, 92 bp, Homo sapiens
aagaagaagaagaaaagaagaagaagaagaagaagaagaagaagaagaagaagaagaagaagaagaagaagaagaagaagaagaagaagcag

SEQ ID NO: 576 - DNA, 101 bp, Homo sapiens
aagaagaagaagaaaagaagaagaagaagaagaagaagaagaagaagaagaagaagaagaagaagaagaagaagaagaagaagaagaagaagaagaagcag

SEQ ID NO: 577 - DNA, 104 bp, Homo sapiens
aagaagaagaagaaaagaagaagaagaagaagaagaagaagaagaagaagaagaagaagaagaagaagaagaagaagaagaagaagaagaagaagaagaagcag

SEQ ID NO: 578 - DNA, 74 bp, Homo sapiens
aagaagaagaagaaaagaagaagaagaagaagaagaagaagaagaagaagaagaagaagaagaagaagaagcag

SEQ ID NO: 579 - DNA, 77 bp, Homo sapiens
aagaagaagaagaaaagaagaagaagaagaagaagaagaagaagaagaagaagaagaagaagaagaagaagaagcag

SEQ ID NO: 580 - DNA, 95 bp, Homo sapiens; identical to SEQ ID NO: 574

SEQ ID NO: 581 - DNA, 92 bp, Homo sapiens; identical to SEQ ID NO: 575

SEQ ID NO: 582 - DNA, 92 bp, Homo sapiens; identical to SEQ ID NO: 575

SEQ ID NO: 583 - DNA, 89 bp, Homo sapiens
aagaagaagaagaaaagaagaagaagaagaagaagaagaagaagaagaagaagaagaagaagaagaagaagaagaagaagaagaagcag

SEQ ID NO: 584 - DNA, 83 bp, Homo sapiens
aagaagaagaagaaaagaagaagaagaagaagaagaagaagaagaagaagaagaagaagaagaagaagaagaagaagaagcag

SEQ ID NO: 585 - DNA, 86 bp, Homo sapiens
aagaagaagaagaaaagaagaagaagaagaagaagaagaagaagaagaagaagaagaagaagaagaagaagaagaagaagaagcag

SEQ ID NO: 586 - DNA, 98 bp, Homo sapiens
aagaagaagaagaaaagaagaagaagaagaagaagaagaagaagaagaagaagaagaagaagaagaagaagaagaagaagaagaagaagaagcagcag

SEQ ID NO: 587 - DNA, 101 bp, Homo sapiens
aagaagaagaagaaaagaagaagaagaagaagaagaagaagaagaagaagaagaagaagaagaagaagaagaagaagaagaagaagaagaagaagcagcag

SEQ ID NO: 588 - DNA, 83 bp, Homo sapiens; identical to SEQ ID NO: 584

SEQ ID NO: 589 - DNA, 86 bp, Homo sapiens; identical to SEQ ID NO: 585

SEQ ID NO: 590 - DNA, 98 bp, Homo sapiens
aagaagaagaagaaaagaagaagaagaagaagaagaagaagaagaagaagaagaagaagaagaagaagaagaagaagaagaagaagaagaagaagcag

SEQ ID NO: 591 - DNA, 95 bp, Homo sapiens; identical to SEQ ID NO: 574

SEQ ID NO: 592 - DNA, 83 bp, Homo sapiens; identical to SEQ ID NO: 584

SEQ ID NO: 593 - DNA, 89 bp, Homo sapiens; identical to SEQ ID NO: 583

SEQ ID NO: 594 - DNA, 101 bp, Homo sapiens; identical to SEQ ID NO: 576

SEQ ID NO: 595 - DNA, 104 bp, Homo sapiens; identical to SEQ ID NO: 577

SEQ ID NO: 596 - DNA, 98 bp, Homo sapiens; identical to SEQ ID NO: 590

SEQ ID NO: 597 - DNA, 101 bp, Homo sapiens; identical to SEQ ID NO: 576

SEQ ID NO: 598 - DNA, 86 bp, Homo sapiens; identical to SEQ ID NO: 585

SEQ ID NO: 599 - DNA, 89 bp, Homo sapiens; identical to SEQ ID NO: 583

SEQ ID NO: 600 - DNA, 92 bp, Homo sapiens; identical to SEQ ID NO: 575

SEQ ID NO: 601 - DNA, 89 bp, Homo sapiens; identical to SEQ ID NO: 583

SEQ ID NO: 602 - DNA, 96 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaagaaagaaagaaagaaagaaa

SEQ ID NO: 603 - DNA, 100 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaagaaagaaagaaagaaagaaagaaa

SEQ ID NO: 604 - DNA, 84 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaagaaagaaa

SEQ ID NO: 605 - DNA, 88 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaagaaagaaagaaa

SEQ ID NO: 606 - DNA, 96 bp, Homo sapiens; identical to SEQ ID NO: 602
  modified_base (13)..(20): a, c, t, g, unknown or other

SEQ ID NO: 607 - DNA, 100 bp, Homo sapiens; identical to SEQ ID NO: 603
  modified_base (13)..(20): a, c, t, g, unknown or other

SEQ ID NO: 608 - DNA, 91 bp, Homo sapiens
  modified_base (13)..(19): a, c, t, g, unknown or other
gaaagaaagaaannnnnnngaaagaaagaaagaaagaaagaaagaaagaaagaaagaaagaaagaaagaaagaaagaaagaaagaaagaaa

SEQ ID NO: 609 - DNA, 96 bp, Homo sapiens; identical to SEQ ID NO: 602
  modified_base (13)..(20): a, c, t, g, unknown or other

SEQ ID NO: 610 - DNA, 103 bp, Homo sapiens
  modified_base (13)..(19): a, c, t, g, unknown or other
gaaagaaagaaannnnnnngaaagaaagaaagaaagaaagaaagaaagaaagaaagaaagaaagaaagaaagaaagaaagaaagaaagaaagaaagaaagaaa

SEQ ID NO: 611 - DNA, 100 bp, Homo sapiens; identical to SEQ ID NO: 603
  modified_base (13)..(20): a, c, t, g, unknown or other

SEQ ID NO: 612 - DNA, 100 bp, Homo sapiens; identical to SEQ ID NO: 603
  modified_base (13)..(20): a, c, t, g, unknown or other

SEQ ID NO: 613 - DNA, 96 bp, Homo sapiens; identical to SEQ ID NO: 602
  modified_base (13)..(20): a, c, t, g, unknown or other

SEQ ID NO: 614 - DNA, 91 bp, Homo sapiens; identical to SEQ ID NO: 608
  modified_base (13)..(19): a, c, t, g, unknown or other

SEQ ID NO: 615 - DNA, 96 bp, Homo sapiens; identical to SEQ ID NO: 602
  modified_base (13)..(20): a, c, t, g, unknown or other

SEQ ID NO: 616 - DNA, 100 bp, Homo sapiens; identical to SEQ ID NO: 603
  modified_base (13)..(20): a, c, t, g, unknown or other

SEQ ID NO: 617 - DNA, 96 bp, Homo sapiens; identical to SEQ ID NO: 602
  modified_base (13)..(20): a, c, t, g, unknown or other

SEQ ID NO: 618 - DNA, 96 bp, Homo sapiens; identical to SEQ ID NO: 602
  modified_base (13)..(20): a, c, t, g, unknown or other

SEQ ID NO: 619 - DNA, 91 bp, Homo sapiens; identical to SEQ ID NO: 608
  modified_base (13)..(19): a, c, t, g, unknown or other

SEQ ID NO: 620 - DNA, 91 bp, Homo sapiens; identical to SEQ ID NO: 608
  modified_base (13)..(19): a, c, t, g, unknown or other

SEQ ID NO: 621 - DNA, 96 bp, Homo sapiens; identical to SEQ ID NO: 602
  modified_base (13)..(20): a, c, t, g, unknown or other

SEQ ID NO: 622 - DNA, 96 bp, Homo sapiens; identical to SEQ ID NO: 602
  modified_base (13)..(20): a, c, t, g, unknown or other

SEQ ID NO: 623 - DNA, 100 bp, Homo sapiens; identical to SEQ ID NO: 603
  modified_base (13)..(20): a, c, t, g, unknown or other

SEQ ID NO: 624 - DNA, 96 bp, Homo sapiens; identical to SEQ ID NO: 602
  modified_base (13)..(20): a, c, t, g, unknown or other

SEQ ID NO: 625 - DNA, 100 bp, Homo sapiens; identical to SEQ ID NO: 603
  modified_base (13)..(20): a, c, t, g, unknown or other

SEQ ID NO: 626 - DNA, 100 bp, Homo sapiens; identical to SEQ ID NO: 603
  modified_base (13)..(20): a, c, t, g, unknown or other

SEQ ID NO: 627 - DNA, 96 bp, Homo sapiens; identical to SEQ ID NO: 602
  modified_base (13)..(20): a, c, t, g, unknown or other

SEQ ID NO: 628 - DNA, 103 bp, Homo sapiens; identical to SEQ ID NO: 610
  modified_base (13)..(19): a, c, t, g, unknown or other

SEQ ID NO: 629 - DNA, 100 bp, Homo sapiens; identical to SEQ ID NO: 603
  modified_base (13)..(20): a, c, t, g, unknown or other

SEQ ID NO: 630 - DNA, 88 bp, Homo sapiens; identical to SEQ ID NO: 605
  modified_base (13)..(20): a, c, t, g, unknown or other

SEQ ID NO: 631 - DNA, 84 bp, Homo sapiens; identical to SEQ ID NO: 604
  modified_base (13)..(20): a, c, t, g, unknown or other

SEQ ID NO: 632 - DNA, 100 bp, Homo sapiens; identical to SEQ ID NO: 603
  modified_base (13)..(20): a, c, t, g, unknown or other

SEQ ID NO: 633 - DNA, 96 bp, Homo sapiens; identical to SEQ ID NO: 602
  modified_base (13)..(20): a, c, t, g, unknown or other

SEQ ID NO: 634 - DNA, 96 bp, Homo sapiens; identical to SEQ ID NO: 602
  modified_base (13)..(20): a, c, t, g, unknown or other

SEQ ID NO: 635 - DNA, 100 bp, Homo sapiens; identical to SEQ ID NO: 603
  modified_base (13)..(20): a, c, t, g, unknown or other

SEQ ID NO: 636 - DNA, 96 bp, Homo sapiens; identical to SEQ ID NO: 602
  modified_base (13)..(20): a, c, t, g, unknown or other

SEQ ID NO: 637 - DNA, 91 bp, Homo sapiens; identical to SEQ ID NO: 608
  modified_base (13)..(19): a, c, t, g, unknown or other

SEQ ID NO: 638 - DNA, 88 bp, Homo sapiens; identical to SEQ ID NO: 605
  modified_base (13)..(20): a, c, t, g, unknown or other

SEQ ID NO: 639 - DNA, 84 bp, Homo sapiens; identical to SEQ ID NO: 604
  modified_base (13)..(20): a, c, t, g, unknown or other

SEQ ID NO: 640 - DNA, 96 bp, Homo sapiens; identical to SEQ ID NO: 602
  modified_base (13)..(20): a, c, t, g, unknown or other

SEQ ID NO: 641 - DNA, 100 bp, Homo sapiens; identical to SEQ ID NO: 603
  modified_base (13)..(20): a, c, t, g, unknown or other

SEQ ID NO: 642 - DNA, 91 bp, Homo sapiens; identical to SEQ ID NO: 608
  modified_base (13)..(19): a, c, t, g, unknown or other

SEQ ID NO: 643 - DNA, 88 bp, Homo sapiens; identical to SEQ ID NO: 605
  modified_base (13)..(20): a, c, t, g, unknown or other

SEQ ID NO: 644 - DNA, 88 bp, Homo sapiens; identical to SEQ ID NO: 605
  modified_base (13)..(20): a, c, t, g, unknown or other

SEQ ID NO: 645 - DNA, 91 bp, Homo sapiens; identical to SEQ ID NO: 608
  modified_base (13)..(19): a, c, t, g, unknown or other

SEQ ID NO: 646 - DNA, 84 bp, Homo sapiens; identical to SEQ ID NO: 604
  modified_base (13)..(20): a, c, t, g, unknown or other

SEQ ID NO: 647 - DNA, 80 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaagaaa

SEQ ID NO: 648 - DNA, 96 bp, Homo sapiens; identical to SEQ ID NO: 602
  modified_base (13)..(20): a, c, t, g, unknown or other

SEQ ID NO: 649 - DNA, 91 bp, Homo sapiens; identical to SEQ ID NO: 608
  modified_base (13)..(19): a, c, t, g, unknown or other

SEQ ID NO: 650 - DNA, 84 bp, Homo sapiens; identical to SEQ ID NO: 604
  modified_base (13)..(20): a, c, t, g, unknown or other

SEQ ID NO: 651 - DNA, 80 bp, Homo sapiens; identical to SEQ ID NO: 647
  modified_base (13)..(20): a, c, t, g, unknown or other

SEQ ID NO: 652 - DNA, 96 bp, Homo sapiens; identical to SEQ ID NO: 602
  modified_base (13)..(20): a, c, t, g, unknown or other

SEQ ID NO: 653 - DNA, 100 bp, Homo sapiens; identical to SEQ ID NO: 603
  modified_base (13)..(20): a, c, t, g, unknown or other

SEQ ID NO: 654 - DNA, 103 bp, Homo sapiens; identical to SEQ ID NO: 610
  modified_base (13)..(19): a, c, t, g, unknown or other

SEQ ID NO: 655 - DNA, 100 bp, Homo sapiens; identical to SEQ ID NO: 603
  modified_base (13)..(20): a, c, t, g, unknown or other

SEQ ID NO: 656 - DNA, 84 bp, Homo sapiens; identical to SEQ ID NO: 604
  modified_base (13)..(20): a, c, t, g, unknown or other

SEQ ID NO: 657 - DNA, 88 bp, Homo sapiens; identical to SEQ ID NO: 605
  modified_base (13)..(20): a, c, t, g, unknown or other

SEQ ID NO: 658 - DNA, 108 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaagaaagaaagaaagaaagaaagaaagaaagaaa

SEQ ID NO: 659 - DNA, 103 bp, Homo sapiens; identical to SEQ ID NO: 610
  modified_base (13)..(19): a, c, t, g, unknown or other

SEQ ID NO: 660 - DNA, 80 bp, Homo sapiens; identical to SEQ ID NO: 647
  modified_base (13)..(20): a, c, t, g, unknown or other

SEQ ID NO: 661 - DNA, 84 bp, Homo sapiens; identical to SEQ ID NO: 604
  modified_base (13)..(20): a, c, t, g, unknown or other

SEQ ID NO: 662 - DNA, 91 bp, Homo sapiens; identical to SEQ ID NO: 608
  modified_base (13)..(19): a, c, t, g, unknown or other

SEQ ID NO: 663 - DNA, 88 bp, Homo sapiens; identical to SEQ ID NO: 605
  modified_base (13)..(20): a, c, t, g, unknown or other

SEQ ID NO: 664 - DNA, 103 bp, Homo sapiens; identical to SEQ ID NO: 610
  modified_base (13)..(19): a, c, t, g, unknown or other

SEQ ID NO: 665 - DNA, 108 bp, Homo sapiens; identical to SEQ ID NO: 658
  modified_base (13)..(20): a, c, t, g, unknown or other

SEQ ID NO: 666 - DNA, 84 bp, Homo sapiens; identical to SEQ ID NO: 604
  modified_base (13)..(20): a, c, t, g, unknown or other

SEQ ID NO: 667 - DNA, 88 bp, Homo sapiens; identical to SEQ ID NO: 605
  modified_base (13)..(20): a, c, t, g, unknown or other

SEQ ID NO: 668 - DNA, 103 bp, Homo sapiens; identical to SEQ ID NO: 610
  modified_base (13)..(19): a, c, t, g, unknown or other

SEQ ID NO: 669 - DNA, 108 bp, Homo sapiens; identical to SEQ ID NO: 658
  modified_base (13)..(20): a, c, t, g, unknown or other

SEQ ID NO: 670 - DNA, 91 bp, Homo sapiens; identical to SEQ ID NO: 608
  modified_base (13)..(19): a, c, t, g, unknown or other

SEQ ID NO: 671 - DNA, 88 bp, Homo sapiens; identical to SEQ ID NO: 605
  modified_base (13)..(20): a, c, t, g, unknown or other

SEQ ID NO: 672 - DNA, 84 bp, Homo sapiens; identical to SEQ ID NO: 604
  modified_base (13)..(20): a, c, t, g, unknown or other

SEQ ID NO: 673 - DNA, 88 bp, Homo sapiens; identical to SEQ ID NO: 605
  modified_base (13)..(20): a, c, t, g, unknown or other

SEQ ID NO: 674 - DNA, 91 bp, Homo sapiens; identical to SEQ ID NO: 608
  modified_base (13)..(19): a, c, t, g, unknown or other

SEQ ID NO: 675 - DNA, 88 bp, Homo sapiens; identical to SEQ ID NO: 605
  modified_base (13)..(20): a, c, t, g, unknown or other

SEQ ID NO: 676 - DNA, 88 bp, Homo sapiens; identical to SEQ ID NO: 605
  modified_base (13)..(20): a, c, t, g, unknown or other

SEQ ID NO: 677 - DNA, 91 bp, Homo sapiens; identical to SEQ ID NO: 608
  modified_base (13)..(19): a, c, t, g, unknown or other

SEQ ID NO: 678 - DNA, 88 bp, Homo sapiens; identical to SEQ ID NO: 605
  modified_base (13)..(20): a, c, t, g, unknown or other

SEQ ID NO: 679 - DNA, 84 bp, Homo sapiens; identical to SEQ ID NO: 604
  modified_base (13)..(20): a, c, t, g, unknown or other

SEQ ID NO: 680 - DNA, 91 bp, Homo sapiens; identical to SEQ ID NO: 608
  modified_base (13)..(19): a, c, t, g, unknown or other

SEQ ID NO: 681 - DNA, 96 bp, Homo sapiens; identical to SEQ ID NO: 602
  modified_base (13)..(20): a, c, t, g, unknown or other

SEQ ID NO: 682 - DNA, 96 bp, Homo sapiens; identical to SEQ ID NO: 602
  modified_base (13)..(20): a, c, t, g, unknown or other

SEQ ID NO: 683 - DNA, 91 bp, Homo sapiens; identical to SEQ ID NO: 608
  modified_base (13)..(19): a, c, t, g, unknown or other

SEQ ID NO: 684 - DNA, 103 bp, Homo sapiens; identical to SEQ ID NO: 610
  modified_base (13)..(19): a, c, t, g, unknown or other

SEQ ID NO: 685 - DNA, 100 bp, Homo sapiens; identical to SEQ ID NO: 603
  modified_base (13)..(20): a, c, t, g, unknown or other

SEQ ID NO: 686 - DNA, 96 bp, Homo sapiens; identical to SEQ ID NO: 602
  modified_base (13)..(20): a, c, t, g, unknown or other

SEQ ID NO: 687 - DNA, 100 bp, Homo sapiens; identical to SEQ ID NO: 603
  modified_base (13)..(20): a, c, t, g, unknown or other

SEQ ID NO: 688 - DNA, 96 bp, Homo sapiens; identical to SEQ ID NO: 602
  modified_base (13)..(20): a, c, t, g, unknown or other

SEQ ID NO: 689 - DNA, 100 bp, Homo sapiens; identical to SEQ ID NO: 603
  modified_base (13)..(20): a, c, t, g, unknown or other

SEQ ID NO: 690 - DNA, 84 bp, Homo sapiens; identical to SEQ ID NO: 604
  modified_base (13)..(20): a, c, t, g, unknown or other

SEQ ID NO: 691 - DNA, 80 bp, Homo sapiens; identical to SEQ ID NO: 647
  modified_base (13)..(20): a, c, t, g, unknown or other

SEQ ID NO: 692 - DNA, 96 bp, Homo sapiens; identical to SEQ ID NO: 602
  modified_base (13)..(20): a, c, t, g, unknown or other

SEQ ID NO: 693 - DNA, 100 bp, Homo sapiens; identical to SEQ ID NO: 603
  modified_base (13)..(20): a, c, t, g, unknown or other

SEQ ID NO: 694 - DNA, 103 bp, Homo sapiens; identical to SEQ ID NO: 610
  modified_base (13)..(19): a, c, t, g, unknown or other

SEQ ID NO: 695 - DNA, 108 bp, Homo sapiens; identical to SEQ ID NO: 658
  modified_base (13)..(20): a, c, t, g, unknown or other

SEQ ID NO: 696 - DNA, 100 bp, Homo sapiens; identical to SEQ ID NO: 603
  modified_base (13)..(20): a, c, t, g, unknown or other

SEQ ID NO: 697 - DNA, 96 bp, Homo sapiens; identical to SEQ ID NO: 602
  modified_base (13)..(20): a, c, t, g, unknown or other

SEQ ID NO: 698 - DNA, 91 bp, Homo sapiens; identical to SEQ ID NO: 608
  modified_base (13)..(19): a, c, t, g, unknown or other

SEQ ID NO: 699 - DNA, 88 bp, Homo sapiens; identical to SEQ ID NO: 605
  modified_base (13)..(20): a, c, t, g, unknown or other

SEQ ID NO: 700 - DNA, 96 bp, Homo sapiens; identical to SEQ ID NO: 602
  modified_base (13)..(20): a, c, t, g, unknown or other

SEQ ID NO: 701 - DNA, 91 bp, Homo sapiens; identical to SEQ ID NO: 608
  modified_base (13)..(19): a, c, t, g, unknown or other

SEQ ID NO: 702 - DNA, 88 bp, Homo sapiens; identical to SEQ ID NO: 605
  modified_base (13)..(20): a, c, t, g, unknown or other

SEQ ID NO: 703 - DNA, 84 bp, Homo sapiens; identical to SEQ ID NO: 604
  modified_base (13)..(20): a, c, t, g, unknown or other

SEQ ID NO: 704 - DNA, 100 bp, Homo sapiens; identical to SEQ ID NO: 603
  modified_base (13)..(20): a, c, t, g, unknown or other

SEQ ID NO: 705 - DNA, 96 bp, Homo sapiens; identical to SEQ ID NO: 602
  modified_base (13)..(20): a, c, t, g, unknown or other

SEQ ID NO: 706 - DNA, 103 bp, Homo sapiens; identical to SEQ ID NO: 610
  modified_base (13)..(19): a, c, t, g, unknown or other

SEQ ID NO: 707 - DNA, 100 bp, Homo sapiens; identical to SEQ ID NO: 603
  modified_base (13)..(20): a, c, t, g, unknown or other

SEQ ID NO: 708 - DNA, 96 bp, Homo sapiens; identical to SEQ ID NO: 602
  modified_base (13)..(20): a, c, t, g, unknown or other

SEQ ID NO: 709 - DNA, 91 bp, Homo sapiens; identical to SEQ ID NO: 608
  modified_base (13)..(19): a, c, t, g, unknown or other

SEQ ID NO: 710 - DNA, 108 bp, Homo sapiens; identical to SEQ ID NO: 658
  modified_base (13)..(20): a, c, t, g, unknown or other

SEQ ID NO: 711 - DNA, 103 bp, Homo sapiens; identical to SEQ ID NO: 610
  modified_base (13)..(19): a, c, t, g, unknown or other

SEQ ID NO: 712 - DNA, 96 bp, Homo sapiens; identical to SEQ ID NO: 602
  modified_base (13)..(20): a, c, t, g, unknown or other

SEQ ID NO: 713 - DNA, 100 bp, Homo sapiens; identical to SEQ ID NO: 603
  modified_base (13)..(20): a, c, t, g, unknown or other

SEQ ID NO: 714 - DNA, 96 bp, Homo sapiens; identical to SEQ ID NO: 602
  modified_base (13)..(20): a, c, t, g, unknown or other

SEQ ID NO: 715 - DNA, 91 bp, Homo sapiens; identical to SEQ ID NO: 608
  modified_base (13)..(19): a, c, t, g, unknown or other

SEQ ID NO: 716 - DNA, 91 bp, Homo sapiens; identical to SEQ ID NO: 608
  modified_base (13)..(19): a, c, t, g, unknown or other

SEQ ID NO: 717 - DNA, 96 bp, Homo sapiens; identical to SEQ ID NO: 602
  modified_base (13)..(20): a, c, t, g, unknown or other

SEQ ID NO: 718 - DNA, 88 bp, Homo sapiens; identical to SEQ ID NO: 605
  modified_base (13)..(20): a, c, t, g, unknown or other

SEQ ID NO: 719 - DNA, 91 bp, Homo sapiens; identical to SEQ ID NO: 608
  modified_base (13)..(19): a, c, t, g, unknown or other

SEQ ID NO: 720 - DNA, 96 bp, Homo sapiens; identical to SEQ ID NO: 602
  modified_base (13)..(20): a, c, t, g, unknown or other

SEQ ID NO: 721 - DNA, 100 bp, Homo sapiens; identical to SEQ ID NO: 603
  modified_base (13)..(20): a, c, t, g, unknown or other

SEQ ID NO: 722 - DNA, 80 bp, Homo sapiens; identical to SEQ ID NO: 647
  modified_base (13)..(20): a, c, t, g, unknown or other

SEQ ID NO: 723 - DNA, 84 bp, Homo sapiens; identical to SEQ ID NO: 604
  modified_base (13)..(20): a, c, t, g, unknown or other

SEQ ID NO: 724 - DNA, 80 bp, Homo sapiens; identical to SEQ ID NO: 647
  modified_base (13)..(20): a, c, t, g, unknown or other

SEQ ID NO: 725 - DNA, 76 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaagaaa

SEQ ID NO: 726 - DNA, 100 bp, Homo sapiens; identical to SEQ ID NO: 603
  modified_base (13)..(20): a, c, t, g, unknown or other

SEQ ID NO: 727 - DNA, 96 bp, Homo sapiens; identical to SEQ ID NO: 602
  modified_base (13)..(20): a, c, t, g, unknown or other

SEQ ID NO: 728 - DNA, 84 bp, Homo sapiens; identical to SEQ ID NO: 604
  modified_base (13)..(20): a, c, t, g, unknown or other

SEQ ID NO: 729 - DNA, 80 bp, Homo sapiens; identical to SEQ ID NO: 647
  modified_base (13)..(20): a, c, t, g, unknown or other

SEQ ID NO: 730 - DNA, 108 bp, Homo sapiens; identical to SEQ ID NO: 658
  modified_base (13)..(20): a, c, t, g, unknown or other

SEQ ID NO: 731 - DNA, 100 bp, Homo sapiens; identical to SEQ ID NO: 603
  modified_base (13)..(20): a, c, t, g, unknown or other

SEQ ID NO: 732 - DNA, 103 bp, Homo sapiens; identical to SEQ ID NO: 610
  modified_base (13)..(19): a, c, t, g, unknown or other

SEQ ID NO: 733 - DNA, 100 bp, Homo sapiens; identical to SEQ ID NO: 603
  modified_base (13)..(20): a, c, t, g, unknown or other

SEQ ID NO: 734 - DNA, 100 bp, Homo sapiens; identical to SEQ ID NO: 603
  modified_base (13)..(20): a, c, t, g, unknown or other

SEQ ID NO: 735 - DNA, 96 bp, Homo sapiens; identical to SEQ ID NO: 602
  modified_base (13)..(20): a, c, t, g, unknown or other

SEQ ID NO: 736 - DNA, 96 bp, Homo sapiens; identical to SEQ ID NO: 602
  modified_base (13)..(20): a, c, t, g, unknown or other

SEQ ID NO: 737 - DNA, 91 bp, Homo sapiens; identical to SEQ ID NO: 608
  modified_base (13)..(19): a, c, t, g, unknown or other

SEQ ID NO: 738 - DNA, 100 bp, Homo sapiens; identical to SEQ ID NO: 603
  modified_base (13)..(20): a, c, t, g, unknown or other

SEQ ID NO: 739 - DNA, 96 bp, Homo sapiens; identical to SEQ ID NO: 602
  modified_base (13)..(20): a, c, t, g, unknown or other

SEQ ID NO: 740 - DNA, 96 bp, Homo sapiens; identical to SEQ ID NO: 602
  modified_base (13)..(20): a, c, t, g, unknown or other

SEQ ID NO: 741 - DNA, 91 bp, Homo sapiens; identical to SEQ ID NO: 608
  modified_base (13)..(19): a, c, t, g, unknown or other

SEQ ID NO: 742 - DNA, 84 bp, Homo sapiens; identical to SEQ ID NO: 604
  modified_base (13)..(20): a, c, t, g, unknown or other

SEQ ID NO: 743 - DNA, 88 bp, Homo sapiens; identical to SEQ ID NO: 605
  modified_base (13)..(20): a, c, t, g, unknown or other

SEQ ID NO: 744 - DNA, 80 bp, Homo sapiens; identical to SEQ ID NO: 647
  modified_base (13)..(20): a, c, t, g, unknown or other

SEQ ID NO: 745 - DNA, 76 bp, Homo sapiens; identical to SEQ ID NO: 725
  modified_base (13)..(20): a, c, t, g, unknown or other

SEQ ID NO: 746 - DNA, 91 bp, Homo sapiens; identical to SEQ ID NO: 608
  modified_base (13)..(19): a, c, t, g, unknown or other

SEQ ID NO: 747 - DNA, 88 bp, Homo sapiens; identical to SEQ ID NO: 605
  modified_base (13)..(20): a, c, t, g, unknown or other

SEQ ID NO: 748 - DNA, 91 bp, Homo sapiens; identical to SEQ ID NO: 608
  modified_base (13)..(19): a, c, t, g, unknown or other

SEQ ID NO: 749 - DNA, 84 bp, Homo sapiens; identical to SEQ ID NO: 604
  modified_base (13)..(20): a, c, t, g, unknown or other

SEQ ID NO: 750 - DNA, 96 bp, Homo sapiens; identical to SEQ ID NO: 602
  modified_base (13)..(20): a, c, t, g, unknown or other

SEQ ID NO: 751 - DNA, 91 bp, Homo sapiens; identical to SEQ ID NO: 608
  modified_base (13)..(19): a, c, t, g, unknown or other

SEQ ID NO: 752 - DNA, 100 bp, Homo sapiens; identical to SEQ ID NO: 603
  modified_base (13)..(20): a, c, t, g, unknown or other

SEQ ID NO: 753 - DNA, 103 bp, Homo sapiens; identical to SEQ ID NO: 610
  modified_base (13)..(19): a, c, t, g, unknown or other

SEQ ID NO: 754 - DNA, 91 bp, Homo sapiens; identical to SEQ ID NO: 608
  modified_base (13)..(19): a, c, t, g, unknown or other

SEQ ID NO: 755 - DNA, 88 bp, Homo sapiens; identical to SEQ ID NO: 605
  modified_base (13)..(20): a, c, t, g, unknown or other

SEQ ID NO: 756 - DNA, 103 bp, Homo sapiens; identical to SEQ ID NO: 610
  modified_base (13)..(19): a, c, t, g, unknown or other

SEQ ID NO: 757 - DNA, 100 bp, Homo sapiens; identical to SEQ ID NO: 603
  modified_base (13)..(20): a, c, t, g, unknown or other

SEQ ID NO: 758 - DNA, 100 bp, Homo sapiens; identical to SEQ ID NO: 603
  modified_base (13)..(20): a, c, t, g, unknown or other

SEQ ID NO: 759 - DNA, 96 bp, Homo sapiens; identical to SEQ ID NO: 602
  modified_base (13)..(20): a, c, t, g, unknown or other

SEQ ID NO: 760 - DNA, 84 bp, Homo sapiens; identical to SEQ ID NO: 604
  modified_base (13)..(20): a, c, t, g, unknown or other

SEQ ID NO: 761 - DNA, 80 bp, Homo sapiens; identical to SEQ ID NO: 647
  modified_base (13)..(20): a, c, t, g, unknown or other

SEQ ID NO: 762 - DNA, 80 bp, Homo sapiens; identical to SEQ ID NO: 647
  modified_base (13)..(20): a, c, t, g, unknown or other

SEQ ID NO: 763 - DNA, 84 bp, Homo sapiens; identical to SEQ ID NO: 604
  modified_base (13)..(20): a, c, t, g, unknown or other

SEQ ID NO: 764 - DNA, 96 bp, Homo sapiens; identical to SEQ ID NO: 602
  modified_base (13)..(20): a, c, t, g, unknown or other

SEQ ID NO: 765 - DNA, 91 bp, Homo sapiens; identical to SEQ ID NO: 608
  modified_base (13)..(19): a, c, t, g, unknown or other

SEQ ID NO: 766 - DNA, 100 bp, Homo sapiens; identical to SEQ ID NO: 603
  modified_base (13)..(20): a, c, t, g, unknown or other

SEQ ID NO: 767 - DNA, 96 bp, Homo sapiens; identical to SEQ ID NO: 602
  modified_base (13)..(20): a, c, t, g, unknown or other

SEQ ID NO: 768 - DNA, 91 bp, Homo sapiens; identical to SEQ ID NO: 608
  modified_base (13)..(19): a, c, t, g, unknown or other

SEQ ID NO: 769 - DNA, 96 bp, Homo sapiens; identical to SEQ ID NO: 602
  modified_base (13)..(20): a, c, t, g, unknown or other

SEQ ID NO: 770 - DNA, 80 bp, Homo sapiens; identical to SEQ ID NO: 647
  modified_base (13)..(20): a, c, t, g, unknown or other

SEQ ID NO: 771 - DNA, 84 bp, Homo sapiens; identical to SEQ ID NO: 604
  modified_base (13)..(20): a, c, t, g, unknown or other

SEQ ID NO: 772 - DNA, 88 bp, Homo sapiens; identical to SEQ ID NO: 605
  modified_base (13)..(20): a, c, t, g, unknown or other

SEQ ID NO: 773 - DNA, 91 bp, Homo sapiens; identical to SEQ ID NO: 608
  modified_base (13)..(19): a, c, t, g, unknown or other

SEQ ID NO: 774 - DNA, 100 bp, Homo sapiens; identical to SEQ ID NO: 603
  modified_base (13)..(20): a, c, t, g, unknown or other

SEQ ID NO: 775 - DNA, 96 bp, Homo sapiens; identical to SEQ ID NO: 602
  modified_base (13)..(20): a, c, t, g, unknown or other

SEQ ID NO: 776 - DNA, 91 bp, Homo sapiens; identical to SEQ ID NO: 608
  modified_base (13)..(19): a, c, t, g, unknown or other

SEQ ID NO: 777 - DNA, 88 bp, Homo sapiens; identical to SEQ ID NO: 605
  modified_base (13)..(20): a, c, t, g, unknown or other

SEQ ID NO: 778 - DNA, 88 bp, Homo sapiens; identical to SEQ ID NO: 605
  modified_base (13)..(20): a, c, t, g, unknown or other

SEQ ID NO: 779 - DNA, 84 bp, Homo sapiens; identical to SEQ ID NO: 604
  modified_base (13)..(20): a, c, t, g, unknown or other

SEQ ID NO: 780 - DNA, 84 bp, Homo sapiens; identical to SEQ ID NO: 604
  modified_base (13)..(20): a, c, t, g, unknown or other

SEQ ID NO: 781 - DNA, 88 bp, Homo sapiens; identical to SEQ ID NO: 605
  modified_base (13)..(20): a, c, t, g, unknown or other

SEQ ID NO: 782 - DNA, 108 bp, Homo sapiens; identical to SEQ ID NO: 658
  modified_base (13)..(20): a, c, t, g, unknown or other

SEQ ID NO: 783 - DNA, 103 bp, Homo sapiens; identical to SEQ ID NO: 610
  modified_base (13)..(19): a, c, t, g, unknown or other

SEQ ID NO: 784 - DNA, 91 bp, Homo sapiens; identical to SEQ ID NO: 608
  modified_base (13)..(19): a, c, t, g, unknown or other

SEQ ID NO: 785 - DNA, 88 bp, Homo sapiens; identical to SEQ ID NO: 605
  modified_base (13)..(20): a, c, t, g, unknown or other

SEQ ID NO: 786 - DNA, 72 bp, Homo sapiens
  modified_base (13)..(20): a, c, t, g, unknown or other
gaaagaaagaaannnnnnnngaaagaaagaaagaaagaaagaaagaaagaaagaaagaaagaaagaaagaaa

SEQ ID NO: 787 - DNA, 76 bp, Homo sapiens; identical to SEQ ID NO: 725
  modified_base (13)..(20): a, c, t, g, unknown or other

SEQ ID NO: 788 - DNA, 96 bp, Homo sapiens; identical to SEQ ID NO: 602
  modified_base (13)..(20): a, c, t, g, unknown or other

SEQ ID NO: 789 - DNA, 91 bp, Homo sapiens; identical to SEQ ID NO: 608
  modified_base (13)..(19): a, c, t, g, unknown or other

SEQ ID NO: 790 - DNA, 103 bp, Homo sapiens; identical to SEQ ID NO: 610
  modified_base (13)..(19): a, c, t, g, unknown or other

SEQ ID NO: 791 - DNA, 100 bp, Homo sapiens; identical to SEQ ID NO: 603
  modified_base (13)..(20): a, c, t, g, unknown or other

SEQ ID NO: 792 - DNA, 91 bp, Homo sapiens; identical to SEQ ID NO: 608
  modified_base (13)..(19): a, c, t, g, unknown or other

SEQ ID NO: 793 - DNA, 96 bp, Homo sapiens; identical to SEQ ID NO: 602
  modified_base (13)..(20): a, c, t, g, unknown or other

SEQ ID NO: 794 - DNA, 100 bp, Homo sapiens; identical to SEQ ID NO: 603
  modified_base (13)..(20): a, c, t, g, unknown or other

SEQ ID NO: 795 - DNA, 96 bp, Homo sapiens; identical to SEQ ID NO: 602
  modified_base (13)..(20): a, c, t, g, unknown or other

SEQ ID NO: 796 - DNA, 88 bp, Homo sapiens; identical to SEQ ID NO: 605
  modified_base (13)..(20): a, c, t, g, unknown or other

SEQ ID NO: 797 - DNA, 84 bp, Homo sapiens; identical to SEQ ID NO: 604
  modified_base (13)..(20): a, c, t, g, unknown or other

SEQ ID NO: 798 - DNA, 103 bp, Homo sapiens; identical to SEQ ID NO: 610
  modified_base (13)..(19): a, c, t, g, unknown or other

SEQ ID NO: 799 - DNA, 100 bp, Homo sapiens; identical to SEQ ID NO: 603
  modified_base (13)..(20): a, c, t, g, unknown or other

SEQ ID NO: 800 - DNA, 76 bp, Homo sapiens; identical to SEQ ID NO: 725
  modified_base (13)..(20): a, c, t, g, unknown or other

SEQ ID NO: 801 - DNA, 72 bp, Homo sapiens; identical to SEQ ID NO: 786
  modified_base (13)..(20): a, c, t, g, unknown or other

SEQ ID NO: 802 - DNA, 96 bp, Homo sapiens; identical to SEQ ID NO: 602
  modified_base (13)..(20): a, c, t, g, unknown or other

SEQ ID NO: 803 - DNA, 91 bp, Homo sapiens; identical to SEQ ID NO: 608
  modified_base (13)..(19): a, c, t, g, unknown or other

SEQ ID NO: 804 - DNA, 108 bp, Homo sapiens; identical to SEQ ID NO: 658
  modified_base (13)..(20): a, c, t, g, unknown or other

SEQ ID NO: 805 - DNA, 103 bp, Homo sapiens; identical to SEQ ID NO: 610
  modified_base (13)..(19): a, c, t, g, unknown or other

SEQ ID NO: 806 - DNA, 88 bp, Homo sapiens; identical to SEQ ID NO: 605
  modified_base (13)..(20): a, c, t, g, unknown or other

SEQ ID NO: 807 - DNA, 84 bp, Homo sapiens; identical to SEQ ID NO: 604
  modified_base (13)..(20): a, c, t, g, unknown or other

SEQ ID NO: 808 - DNA, 88 bp, Homo sapiens; identical to SEQ ID NO: 605
  modified_base (13)..(20): a, c, t, g, unknown or other

SEQ ID NO: 809 - DNA, 84 bp, Homo sapiens; identical to SEQ ID NO: 604
  modified_base (13)..(20): a, c, t, g, unknown or other

SEQ ID NO: 810 - DNA, 91 bp, Homo sapiens; identical to SEQ ID NO: 608
  modified_base (13)..(19): a, c, t, g, unknown or other

SEQ ID NO: 811 - DNA, 96 bp, Homo sapiens; identical to SEQ ID NO: 602
  modified_base (13)..(20): a, c, t, g, unknown or other

SEQ ID NO: 812 - DNA, 80 bp, Homo sapiens; identical to SEQ ID NO: 647
  modified_base (13)..(20): a, c, t, g, unknown or other

SEQ ID NO: 813 - DNA, 84 bp, Homo sapiens; identical to SEQ ID NO: 604
  modified_base (13)..(20): a, c, t, g, unknown or other

SEQ ID NO: 814 - DNA, 100 bp, Homo sapiens; identical to SEQ ID NO: 603
  modified_base (13)..(20): a, c, t, g, unknown or other

SEQ ID NO: 815 - DNA, 103 bp, Homo sapiens; identical to SEQ ID NO: 610
  modified_base (13)..(19): a, c, t, g, unknown or other

SEQ ID NO: 816 - DNA, 88 bp, Homo sapiens; identical to SEQ ID NO: 605
  modified_base (13)..(20): a, c, t, g, unknown or other

SEQ ID NO: 817 - DNA, 91 bp, Homo sapiens; identical to SEQ ID NO: 608
  modified_base (13)..(19): a, c, t, g, unknown or other

SEQ ID NO: 818 - DNA, 76 bp, Homo sapiens; identical to SEQ ID NO: 725
  modified_base (13)..(20): a, c, t, g, unknown or other

SEQ ID NO: 819 - DNA, 80 bp, Homo sapiens; identical to SEQ ID NO: 647
  modified_base (13)..(20): a, c, t, g, unknown or other

SEQ ID NO: 820 - DNA, 96 bp, Homo sapiens; identical to SEQ ID NO: 602
  modified_base (13)..(20): a, c, t, g, unknown or other

SEQ ID NO: 821 - DNA, 91 bp, Homo sapiens; identical to SEQ ID NO: 608
  modified_base (13)..(19): a, c, t, g, unknown or other

SEQ ID NO: 822 - DNA, 96 bp, Homo sapiens; identical to SEQ ID NO: 602
  modified_base (13)..(20): a, c, t, g, unknown or other

SEQ ID NO: 823 - DNA, 100 bp, Homo sapiens; identical to SEQ ID NO: 603
  modified_base (13)..(20): a, c, t, g, unknown or other

SEQ ID NO: 824 - DNA, 88 bp, Homo sapiens; identical to SEQ ID NO: 605
  modified_base (13)..(20): a, c, t, g, unknown or other

SEQ ID NO: 825 - DNA, 91 bp, Homo sapiens; identical to SEQ ID NO: 608
  modified_base (13)..(19): a, c, t, g, unknown or other

SEQ ID NO: 826 - DNA, 96 bp, Homo sapiens; identical to SEQ ID NO: 602
  modified_base (13)..(20): a, c, t, g, unknown or other

SEQ ID NO: 827 - DNA, 91 bp, Homo sapiens; identical to SEQ ID NO: 608
  modified_base (13)..(19): a, c, t, g, unknown or other

SEQ ID NO: 828 - DNA, 88 bp, Homo sapiens; identical to SEQ ID NO: 605
  modified_base (13)..(20): a, c, t, g, unknown or other

SEQ ID NO: 829 - DNA, 84 bp, Homo sapiens; identical to SEQ ID NO: 604
  modified_base (13)..(20): a, c, t, g, unknown or other

SEQ ID NO: 830 - DNA, 100 bp, Homo sapiens; identical to SEQ ID NO: 603
  modified_base (13)..(20): a, c, t, g, unknown or other

SEQ ID NO: 831 - DNA, 96 bp, Homo sapiens; identical to SEQ ID NO: 602
  modified_base (13)..(20): a, c, t, g, unknown or other

SEQ ID NO: 832 - DNA, 91 bp, Homo sapiens; identical to SEQ ID NO: 608
  modified_base (13)..(19): a, c, t, g, unknown or other

SEQ ID NO: 833 - DNA, 96 bp, Homo sapiens; identical to SEQ ID NO: 602
  modified_base (13)..(20): a, c, t, g, unknown or other

SEQ ID NO: 834 - DNA, 96 bp, Homo sapiens; identical to SEQ ID NO: 602
  modified_base (13)..(20): a, c, t, g, unknown or other

SEQ ID NO: 835 - DNA, 91 bp, Homo sapiens; identical to SEQ ID NO: 608
  modified_base (13)..(19): a, c, t, g, unknown or other

SEQ ID NO: 836 - DNA, 76 bp, Homo sapiens; identical to SEQ ID NO: 725
  modified_base (13)..(20): a, c, t, g, unknown or other

SEQ ID NO: 837 - DNA, 80 bp, Homo sapiens; identical to SEQ ID NO: 647
  modified_base (13)..(20): a, c, t, g, unknown or other

SEQ ID NO: 838 - DNA, 108 bp, Homo sapiens; identical to SEQ ID NO: 658
  modified_base (13)..(20): a, c, t, g, unknown or other

SEQ ID NO: 839 - DNA, 103 bp, Homo sapiens; identical to SEQ ID NO: 610
  modified_base (13)..(19): a, c, t, g, unknown or other

SEQ ID NO: 840 - DNA, 84 bp, Homo sapiens; identical to SEQ ID NO: 604
  modified_base (13)..(20): a, c, t, g, unknown or other

SEQ ID NO: 841 - DNA, 100 bp, Homo sapiens; identical to SEQ ID NO: 603
  modified_base (13)..(20): a, c, t, g, unknown or other

SEQ ID NO: 842 - DNA, 80 bp, Homo sapiens; identical to SEQ ID NO: 647
  modified_base (13)..(20): a, c, t, g, unknown or other

SEQ ID NO: 843 - DNA, 76 bp, Homo sapiens; identical to SEQ ID NO: 725
  modified_base (13)..(20): a, c, t, g, unknown or other

SEQ ID NO: 844 - DNA, 91 bp, Homo sapiens; identical to SEQ ID NO: 608
  modified_base (13)..(19): a, c, t, g, unknown or other

SEQ ID NO: 845 - DNA, 96 bp, Homo sapiens; identical to SEQ ID NO: 602
  modified_base (13)..(20): a, c, t, g, unknown or other

SEQ ID NO: 846 - DNA, 100 bp, Homo sapiens; identical to SEQ ID NO: 603
  modified_base (13)..(20): a, c, t, g, unknown or other

SEQ ID NO: 847 - DNA, 103 bp, Homo sapiens; identical to SEQ ID NO: 610
  modified_base (13)..(19): a, c, t, g, unknown or other

SEQ ID NO: 848 - DNA, 96 bp, Homo sapiens; identical to SEQ ID NO: 602
  modified_base (13)..(20): a, c, t, g, unknown or other

SEQ ID NO: 849 - DNA, 91 bp, Homo sapiens; identical to SEQ ID NO: 608
  modified_base (13)..(19): a, c, t, g, unknown or other

SEQ ID NO: 850 - DNA, 84 bp, Homo sapiens; identical to SEQ ID NO: 604
  modified_base (13)..(20): a, c, t, g, unknown or other

SEQ ID NO: 851 - DNA, 88 bp, Homo sapiens; identical to SEQ ID NO: 605
  modified_base (13)..(20): a, c, t, g, unknown or other

SEQ ID NO: 852 - DNA, 100 bp, Homo sapiens; identical to SEQ ID NO: 603
  modified_base (13)..(20): a, c, t, g, unknown or other

SEQ ID NO: 853 - DNA, 103 bp, Homo sapiens; identical to SEQ ID NO: 610
  modified_base (13)..(19): a, c, t, g, unknown or other

SEQ ID NO: 854 - DNA, 88 bp, Homo sapiens; identical to SEQ ID NO: 605
  modified_base (13)..(20): a, c, t, g, unknown or other

SEQ ID NO: 855 - DNA, 91 bp, Homo sapiens; identical to SEQ ID NO: 608
  modified_base (13)..(19): a, c, t, g, unknown or other

SEQ ID NO: 856 - DNA, 100 bp, Homo sapiens; identical to SEQ ID NO: 603
  modified_base (13)..(20): a, c, t, g, unknown or other

SEQ ID NO: 857 - DNA, 96 bp, Homo sapiens; identical to SEQ ID NO: 602
  modified_base (13)..(20): a, c, t, g, unknown or other

SEQ ID NO: 858 - DNA, 80 bp, Homo sapiens; identical to SEQ ID NO: 647
  modified_base (13)..(20): a, c, t, g, unknown or other

SEQ ID NO: 859 - DNA, 84 bp, Homo sapiens; identical to SEQ ID NO: 604
  modified_base (13)..(20): a, c, t, g, unknown or other

SEQ ID NO: 860 - DNA, 103 bp, Homo sapiens; identical to SEQ ID NO: 610
  modified_base (13)..(19): a, c, t, g, unknown or other

SEQ ID NO: 861 - DNA, 100 bp, Homo sapiens; identical to SEQ ID NO: 603
  modified_base (13)..(20): a, c, t, g, unknown or other

SEQ ID NO: 862 - DNA, 108 bp, Homo sapiens; identical to SEQ ID NO: 658
  modified_base (13)..(20): a, c, t, g, unknown or other

SEQ ID NO: 863 - DNA, 103 bp, Homo sapiens; identical to SEQ ID NO: 610
  modified_base (13)..(19): a, c, t, g, unknown or other

SEQ ID NO: 864 - DNA, 108 bp, Homo sapiens; identical to SEQ ID NO: 658
  modified_base (13)..(20): a, c, t, g, unknown or other

SEQ ID NO: 865 - DNA, 112 bp, Homo sapiens; identical to SEQ ID NO: 12
  modified_base (13)..(20): a, c, t, g, unknown or other

SEQ ID NO: 866 - DNA, 88 bp, Homo sapiens; identical to SEQ ID NO: 605
  modified_base (13)..(20): a, c, t, g, unknown or other

SEQ ID NO: 867 - DNA, 84 bp, Homo sapiens; identical to SEQ ID NO: 604
  modified_base (13)..(20): a, c, t, g, unknown or other

SEQ ID NO: 868 - DNA, 84 bp, Homo sapiens; identical to SEQ ID NO: 604
  modified_base (13)..(20): a, c, t, g, unknown or other

SEQ ID NO: 869 - DNA, 80 bp, Homo sapiens; identical to SEQ ID NO: 647
  modified_base (13)..(20): a, c, t, g, unknown or other

SEQ ID NO: 870 - DNA, 91 bp, Homo sapiens; identical to SEQ ID NO: 608
  modified_base (13)..(19): a, c, t, g, unknown or other

SEQ ID NO: 871 - DNA, 96 bp, Homo sapiens; identical to SEQ ID NO: 602
  modified_base (13)..(20): a, c, t, g, unknown or other

SEQ ID NO: 872 - DNA, 103 bp, Homo sapiens; identical to SEQ ID NO: 610
  modified_base (13)..(19): a, c, t, g, unknown or other

SEQ ID NO: 873 - DNA, 100 bp, Homo sapiens; identical to SEQ ID NO: 603
  modified_base (13)..(20): a, c, t, g, unknown or other

SEQ ID NO: 874 - DNA, 84 bp, Homo sapiens; identical to SEQ ID NO: 604
  modified_base (13)..(20): a, c, t, g, unknown or other

SEQ ID NO: 875 - DNA, 80 bp, Homo sapiens; identical to SEQ ID NO: 647
  modified_base (13)..(20): a, c, t, g, unknown or other

SEQ ID NO: 876 - DNA, 96 bp, Homo sapiens; identical to SEQ ID NO: 602
  modified_base (13)..(20): a, c, t, g, unknown or other

SEQ ID NO: 877 - DNA, 91 bp, Homo sapiens; identical to SEQ ID NO: 608
  modified_base (13)..(19): a, c, t, g, unknown or other

SEQ ID NO: 878 - DNA, 88 bp, Homo sapiens; identical to SEQ ID NO: 605
  modified_base (13)..(20): a, c, t, g, unknown or other

SEQ ID NO: 879 - DNA, 84 bp, Homo sapiens; identical to SEQ ID NO: 604
  modified_base (13)..(20): a, c, t, g, unknown or other

SEQ ID NO: 880 - DNA, 213 bp, Homo sapiens
  modified_base (29)..(67): a, c, t, g, unknown or other
  modified_base (80)..(87): a, c, t, g, unknown or other
  modified_base (116)..(128): a, c, t, g, unknown or other
aaggaaggaaggaagcaaggaaggaaggnnnnnnnnnnnnnnnnnnnnnnnnnnnnnnnnnnnnnnnaaggaaggaaggnnnnnnnnaaggaaggaaggaaagaaggaaggaaggnnnnnnnnnnnnnaaagaaagaaagaaagaaagaaagaaagaaagaaagaaagaaagaaagaaagaaagaaaggaaggaaggaaggaaggaaggaagg

SEQ ID NO: 881 - DNA, 217 bp, Homo sapiens
  modified_base (29)..(67): a, c, t, g, unknown or other
  modified_base (80)..(87): a, c, t, g, unknown or other
  modified_base (116)..(128): a, c, t, g, unknown or other
aaggaaggaaggaagcaaggaaggaaggnnnnnnnnnnnnnnnnnnnnnnnnnnnnnnnnnnnnnnnaaggaaggaaggnnnnnnnnaaggaaggaaggaaagaaggaaggaaggnnnnnnnnnnnnnaaagaaagaaagaaagaaagaaagaaagaaagaaagaaagaaagaaagaaagaaagaaagaaaggaaggaaggaaggaaggaaggaagg

SEQ ID NO: 882 - DNA, 221 bp, Homo sapiens
  modified_base (29)..(67): a, c, t, g, unknown or other
  modified_base (80)..(87): a, c, t, g, unknown or other
  modified_base (116)..(128): a, c, t, g, unknown or other
aaggaaggaaggaagcaaggaaggaaggnnnnnnnnnnnnnnnnnnnnnnnnnnnnnnnnnnnnnnnaaggaaggaaggnnnnnnnnaaggaaggaaggaaagaaggaaggaaggnnnnnnnnnnnnnaaagaaagaaagaaagaaagaaagaaagaaagaaagaaagaaagaaagaaagaaagaaagaaagaaaggaaggaaggaaggaaggaaggaagg

SEQ ID NO: 883 - DNA, 213 bp, Homo sapiens; identical to SEQ ID NO: 880
  modified_base (29)..(67): a, c, t, g, unknown or other
  modified_base (80)..(87): a, c, t, g, unknown or other
  modified_base (116)..(128): a, c, t, g, unknown or other

SEQ ID NO: 884 - DNA, 213 bp, Homo sapiens; identical to SEQ ID NO: 880
  modified_base (29)..(67): a, c, t, g, unknown or other
  modified_base (80)..(87): a, c, t, g, unknown or other
  modified_base (116)..(128): a, c, t, g, unknown or other

SEQ ID NO: 885 - DNA, 217 bp, Homo sapiens; identical to SEQ ID NO: 881
  modified_base (29)..(67): a, c, t, g, unknown or other
  modified_base (80)..(87): a, c, t, g, unknown or other
  modified_base (116)..(128): a, c, t, g, unknown or other

SEQ ID NO: 886 - DNA, 213 bp, Homo sapiens; identical to SEQ ID NO: 880
  modified_base (29)..(67): a, c, t, g, unknown or other
  modified_base (80)..(87): a, c, t, g, unknown or other
  modified_base (116)..(128): a, c, t, g, unknown or other

SEQ ID NO: 887 - DNA, 217 bp, Homo sapiens; identical to SEQ ID NO: 881
  modified_base (29)..(67): a, c, t, g, unknown or other
  modified_base (80)..(87): a, c, t, g, unknown or other
  modified_base (116)..(128): a, c, t, g, unknown or other

SEQ ID NO: 888 - DNA, 213 bp, Homo sapiens; identical to SEQ ID NO: 880
  modified_base (29)..(67): a, c, t, g, unknown or other
  modified_base (80)..(87): a, c, t, g, unknown or other
  modified_base (116)..(128): a, c, t, g, unknown or other

SEQ ID NO: 889 - DNA, 99 bp, Homo sapiens
  modified_base (29)..(67): a, c, t, g, unknown or other
  modified_base (80)..(87): a, c, t, g, unknown or other
aaggaaggaaggaagcaaggaaggaaggnnnnnnnnnnnnnnnnnnnnnnnnnnnnnnnnnnnnnnnaaggaaggaaggnnnnnnnnaaggaaggaagg

SEQ ID NO: 890 - DNA, 217 bp, Homo sapiens; identical to SEQ ID NO: 881
  modified_base (29)..(67): a, c, t, g, unknown or other
  modified_base (80)..(87): a, c, t, g, unknown or other
  modified_base (116)..(128): a, c, t, g, unknown or other

SEQ ID NO: 891 - DNA, 99 bp, Homo sapiens; identical to SEQ ID NO: 889
  modified_base (29)..(67): a, c, t, g, unknown or other
  modified_base (80)..(87): a, c, t, g, unknown or other

SEQ ID NO: 892 - DNA, 217 bp, Homo sapiens; identical to SEQ ID NO: 881
  modified_base (29)..(67): a, c, t, g, unknown or other
  modified_base (80)..(87): a, c, t, g, unknown or other
  modified_base (116)..(128): a, c, t, g, unknown or other

SEQ ID NO: 893 - DNA, 99 bp, Homo sapiens; identical to SEQ ID NO: 889
  modified_base (29)..(67): a, c, t, g, unknown or other
  modified_base (80)..(87): a, c, t, g, unknown or other

SEQ ID NO: 894 - DNA, 221 bp, Homo sapiens; identical to SEQ ID NO: 882
  modified_base (29)..(67): a, c, t, g, unknown or other
  modified_base (80)..(87): a, c, t, g, unknown or other
  modified_base (116)..(128): a, c, t, g, unknown or other

SEQ ID NO: 895 - DNA, 99 bp, Homo sapiens; identical to SEQ ID NO: 889
  modified_base (29)..(67): a, c, t, g, unknown or other
  modified_base (80)..(87): a, c, t, g, unknown or other

SEQ ID NO: 896 - DNA, 114 bp, Homo sapiens
  modified_base (61)..(102): a, c, t, g, unknown or other
tttctttctttctttctttctttctttctttctttctttctttctttctttctttctttcnnnnnnnnnnnnnnnnnnnnnnnnnnnnnnnnnnnnnnnnnntttctttctttc

SEQ ID NO: 897 - DNA, 118 bp, Homo sapiens
  modified_base (65)..(106): a, c, t, g, unknown or other
tttctttctttctttctttctttctttctttctttctttctttctttctttctttctttctttcnnnnnnnnnnnnnnnnnnnnnnnnnnnnnnnnnnnnnnnnnntttctttctttc

SEQ ID NO: 898 - DNA, 114 bp, Homo sapiens; identical to SEQ ID NO: 896
  modified_base (61)..(102): a, c, t, g, unknown or other

SEQ ID NO: 899 - DNA, 110 bp, Homo sapiens
  modified_base (57)..(98): a, c, t, g, unknown or other
tttctttctttctttctttctttctttctttctttctttctttctttctttctttcnnnnnnnnnnnnnnnnnnnnnnnnnnnnnnnnnnnnnnnnnntttctttctttc

SEQ ID NO: 900 - DNA, 118 bp, Homo sapiens; identical to SEQ ID NO: 897
  modified_base (65)..(106): a, c, t, g, unknown or other

SEQ ID NO: 901 - DNA, 122 bp, Homo sapiens
  modified_base (69)..(110): a, c, t, g, unknown or other
tttctttctttctttctttctttctttctttctttctttctttctttctttctttctttctttctttcnnnnnnnnnnnnnnnnnnnnnnnnnnnnnnnnnnnnnnnnnntttctttctttc

SEQ ID NO: 902 - DNA, 118 bp, Homo sapiens; identical to SEQ ID NO: 897
  modified_base (65)..(106): a, c, t, g, unknown or other

SEQ ID NO: 903 - DNA, 122 bp, Homo sapiens; identical to SEQ ID NO: 901
  modified_base (69)..(110): a, c, t, g, unknown or other

SEQ ID NO: 904 - DNA, 118 bp, Homo sapiens; identical to SEQ ID NO: 897
  modified_base (65)..(106): a, c, t, g, unknown or other

SEQ ID NO: 905 - DNA, 122 bp, Homo sapiens; identical to SEQ ID NO: 901
  modified_base (69)..(110): a, c, t, g, unknown or other

SEQ ID NO: 906 - DNA, 114 bp, Homo sapiens; identical to SEQ ID NO: 896
  modified_base (61)..(102): a, c, t, g, unknown or other

SEQ ID NO: 907 - DNA, 118 bp, Homo sapiens; identical to SEQ ID NO: 897
  modified_base (65)..(106): a, c, t, g, unknown or other

SEQ ID NO: 908 - DNA, 114 bp, Homo sapiens; identical to SEQ ID NO: 896
  modified_base (61)..(102): a, c, t, g, unknown or other

SEQ ID NO: 909 - DNA, 118 bp, Homo sapiens; identical to SEQ ID NO: 897
  modified_base (65)..(106): a, c, t, g, unknown or other

SEQ ID NO: 910 - DNA, 118 bp, Homo sapiens; identical to SEQ ID NO: 897
  modified_base (65)..(106): a, c, t, g, unknown or other

SEQ ID NO: 911 - DNA, 122 bp, Homo sapiens; identical to SEQ ID NO: 901
  modified_base (69)..(110): a, c, t, g, unknown or other

SEQ ID NO: 912 - DNA, 110 bp, Homo sapiens; identical to SEQ ID NO: 899
  modified_base (57)..(98): a, c, t, g, unknown or other

SEQ ID NO: 913 - DNA, 114 bp, Homo sapiens; identical to SEQ ID NO: 896
  modified_base (61)..(102): a, c, t, g, unknown or other

SEQ ID NO: 914 - DNA, 114 bp, Homo sapiens; identical to SEQ ID NO: 896
  modified_base (61)..(102): a, c, t, g, unknown or other

SEQ ID NO: 915 - DNA, 118 bp, Homo sapiens; identical to SEQ ID NO: 897
  modified_base (65)..(106): a, c, t, g, unknown or other

SEQ ID NO: 916 - DNA, 126 bp, Homo sapiens
  modified_base (73)..(114): a, c, t, g, unknown or other
tttctttctttctttctttctttctttctttctttctttctttctttctttctttctttctttctttctttcnnnnnnnnnnnnnnnnnnnnnnnnnnnnnnnnnnnnnnnnnntttctttctttc

SEQ ID NO: 917 - DNA, 122 bp, Homo sapiens; identical to SEQ ID NO: 901
  modified_base (69)..(110): a, c, t, g, unknown or other

SEQ ID NO: 918 - DNA, 110 bp, Homo sapiens; identical to SEQ ID NO: 899
  modified_base (57)..(98): a, c, t, g, unknown or other

SEQ ID NO: 919 - DNA, 114 bp, Homo sapiens; identical to SEQ ID NO: 896
  modified_base (61)..(102): a, c, t, g, unknown or other

SEQ ID NO: 920 - DNA, 118 bp, Homo sapiens; identical to SEQ ID NO: 897
  modified_base (65)..(106): a, c, t, g, unknown or other

SEQ ID NO: 921 - DNA, 114 bp, Homo sapiens; identical to SEQ ID NO: 896
  modified_base (61)..(102): a, c, t, g, unknown or other

SEQ ID NO: 922 - DNA, 118 bp, Homo sapiens; identical to SEQ ID NO: 897
  modified_base (65)..(106): a, c, t, g, unknown or other

SEQ ID NO: 923 - DNA, 122 bp, Homo sapiens; identical to SEQ ID NO: 901
  modified_base (69)..(110): a, c, t, g, unknown or other

SEQ ID NO: 924 - DNA, 114 bp, Homo sapiens; identical to SEQ ID NO: 896
  modified_base (61)..(102): a, c, t, g, unknown or other

SEQ ID NO: 925 - DNA, 110 bp, Homo sapiens; identical to SEQ ID NO: 899
  modified_base (57)..(98): a, c, t, g, unknown or other

SEQ ID NO: 926 - DNA, 122 bp, Homo sapiens; identical to SEQ ID NO: 901
  modified_base (69)..(110): a, c, t, g, unknown or other

SEQ ID NO: 927 - DNA, 126 bp, Homo sapiens; identical to SEQ ID NO: 916
  modified_base (73)..(114): a, c, t, g, unknown or other

SEQ ID NO: 928 - DNA, 122 bp, Homo sapiens; identical to SEQ ID NO: 901
  modified_base (69)..(110): a, c, t, g, unknown or other

SEQ ID NO: 929 - DNA, 118 bp, Homo sapiens; identical to SEQ ID NO: 897
  modified_base (65)..(106): a, c, t, g, unknown or other

SEQ ID NO: 930 - DNA, 118 bp, Homo sapiens; identical to SEQ ID NO: 897
  modified_base (65)..(106): a, c, t, g, unknown or other

SEQ ID NO: 931 - DNA, 122 bp, Homo sapiens; identical to SEQ ID NO: 901
  modified_base (69)..(110): a, c, t, g, unknown or other

SEQ ID NO: 932 - DNA, 114 bp, Homo sapiens; identical to SEQ ID NO: 896
  modified_base (61)..(102): a, c, t, g, unknown or other

SEQ ID NO: 933 - DNA, 110 bp, Homo sapiens; identical to SEQ ID NO: 899
  modified_base (57)..(98): a, c, t, g, unknown or other

SEQ ID NO: 934 - DNA, 126 bp, Homo sapiens; identical to SEQ ID NO: 916
  modified_base (73)..(114): a, c, t, g, unknown or other

SEQ ID NO: 935 - DNA, 122 bp, Homo sapiens; identical to SEQ ID NO: 901
  modified_base (69)..(110): a, c, t, g, unknown or other

SEQ ID NO: 936 - DNA, 122 bp, Homo sapiens; identical to SEQ ID NO: 901
  modified_base (69)..(110): a, c, t, g, unknown or other

SEQ ID NO: 937 - DNA, 126 bp, Homo sapiens; identical to SEQ ID NO: 916
  modified_base (73)..(114): a, c, t, g, unknown or other

SEQ ID NO: 938 - DNA, 187 bp, Homo sapiens
  modified_base (45)..(159): a, c, t, g, unknown or other
ggaaggaaggaaggaaggaaggaaggaaggaaggaaggaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggaaggaagaaaggaaggaaggaa

SEQ ID NO: 939 - DNA, 191 bp, Homo sapiens
  modified_base (49)..(163): a, c, t, g, unknown or other
ggaaggaaggaaggaaggaaggaaggaaggaaggaaggaaggaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggaaggaagaaaggaaggaaggaa

SEQ ID NO: 940 - DNA, 199 bp, Homo sapiens; identical to SEQ ID NO: 17
  modified_base (57)..(171): a, c, t, g, unknown or other

SEQ ID NO: 941 - DNA, 195 bp, Homo sapiens
  modified_base (53)..(167): a, c, t, g, unknown or other
ggaaggaaggaaggaaggaaggaaggaaggaaggaaggaaggaaggaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggaaggaagaaaggaaggaaggaa

SEQ ID NO: 942 - DNA, 48 bp, Homo sapiens; identical to SEQ ID NO: 171

SEQ ID NO: 943 - DNA, 44 bp, Homo sapiens
tatctatctatctatctatctatctatctatctatctatctatc

SEQ ID NO: 944 - DNA, 44 bp, Homo sapiens; identical to SEQ ID NO: 943

SEQ ID NO: 945 - DNA, 40 bp, Homo sapiens
tatctatctatctatctatctatctatctatctatctatc

SEQ ID NO: 946 - DNA, 48 bp, Homo sapiens; identical to SEQ ID NO: 171

SEQ ID NO: 947 - DNA, 52 bp, Homo sapiens
tatctatctatctatctatctatctatctatctatctatctatctatctatc

SEQ ID NO: 948 - DNA, 44 bp, Homo sapiens; identical to SEQ ID NO: 943

SEQ ID NO: 949 - DNA, 40 bp, Homo sapiens; identical to SEQ ID NO: 945

SEQ ID NO: 950 - DNA, 48 bp, Homo sapiens; identical to SEQ ID NO: 171

SEQ ID NO: 951 - DNA, 52 bp, Homo sapiens; identical to SEQ ID NO: 947

SEQ ID NO: 952 - DNA, 48 bp, Homo sapiens; identical to SEQ ID NO: 171

SEQ ID NO: 953 - DNA, 52 bp, Homo sapiens; identical to SEQ ID NO: 947

SEQ ID NO: 954 - DNA, 36 bp, Homo sapiens
aaataaataaataaataaataaataaataaataaat

SEQ ID NO: 955 - DNA, 40 bp, Homo sapiens; identical to SEQ ID NO: 141

SEQ ID NO: 956 - DNA, 36 bp, Homo sapiens; identical to SEQ ID NO: 954

SEQ ID NO: 957 - DNA, 40 bp, Homo sapiens; identical to SEQ ID NO: 141

SEQ ID NO: 958 - DNA, 68 bp, Homo sapiens
tagatagatagataggtagatagatagatagatagatagatagatagatagatagatagatagataga

SEQ ID NO: 959 - DNA, 72 bp, Homo sapiens
tagatagatagataggtagatagatagatagatagatagatagatagatagatagatagatagatagataga

SEQ ID NO: 960 - DNA, 60 bp, Homo sapiens
tagatagatagataggtagatagatagatagatagatagatagatagatagatagataga

SEQ ID NO: 961 - DNA, 64 bp, Homo sapiens
tagatagatagataggtagatagatagatagatagatagatagatagatagatagatagataga

SEQ ID NO: 962 - DNA, 72 bp, Homo sapiens; identical to SEQ ID NO: 959

SEQ ID NO: 963 - DNA, 68 bp, Homo sapiens; identical to SEQ ID NO: 958

SEQ ID NO: 964 - DNA, 72 bp, Homo sapiens; identical to SEQ ID NO: 959

SEQ ID NO: 965 - DNA, 76 bp, Homo sapiens
tagatagatagataggtagatagatagatagatagatagatagatagatagatagatagatagatagatagataga

SEQ ID NO: 966 - DNA, 64 bp, Homo sapiens; identical to SEQ ID NO: 961

SEQ ID NO: 967 - DNA, 68 bp, Homo sapiens; identical to SEQ ID NO: 958

SEQ ID NO: 968 - DNA, 72 bp, Homo sapiens; identical to SEQ ID NO: 959

SEQ ID NO: 969 - DNA, 68 bp, Homo sapiens; identical to SEQ ID NO: 958

SEQ ID NO: 970 - DNA, 72 bp, Homo sapiens; identical to SEQ ID NO: 959

SEQ ID NO: 971 - DNA, 68 bp, Homo sapiens; identical to SEQ ID NO: 958

SEQ ID NO: 972 - DNA, 171 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaagggaaagaaagaaagaaagaaagaaagaaagaaagaaagaaagaaagaaagaaa

SEQ ID NO: 973 - DNA, 167 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaagggaaagaaagaaagaaagaaagaaagaaagaaagaaagaaagaaagaaagaaa

SEQ ID NO: 974 - DNA, 171 bp, Homo sapiens; identical to SEQ ID NO: 972
  modified_base (17)..(30): a, c, t, g, unknown or other
  modified_base (43)..(54): a, c, t, g, unknown or other
  modified_base (67)..(95): a, c, t, g, unknown or other

SEQ ID NO: 975 - DNA, 175 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaagggaaagaaagaaagaaagaaagaaagaaagaaagaaagaaagaaagaaagaaagaaa

SEQ ID NO: 976 - DNA, 175 bp, Homo sapiens; identical to SEQ ID NO: 975
  modified_base (17)..(30): a, c, t, g, unknown or other
  modified_base (43)..(54): a, c, t, g, unknown or other
  modified_base (67)..(95): a, c, t, g, unknown or other

SEQ ID NO: 977 - DNA, 179 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaagggaaagaaagaaagaaagaaagaaagaaagaaagaaagaaagaaagaaagaaagaaagaaa

SEQ ID NO: 978 - DNA, 179 bp, Homo sapiens; identical to SEQ ID NO: 977
  modified_base (17)..(30): a, c, t, g, unknown or other
  modified_base (43)..(54): a, c, t, g, unknown or other
  modified_base (67)..(95): a, c, t, g, unknown or other

SEQ ID NO: 979 - DNA, 183 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaagggaaagaaagaaagaaagaaagaaagaaagaaagaaagaaagaaagaaagaaagaaagaaagaaa

SEQ ID NO: 980 - DNA, 179 bp, Homo sapiens; identical to SEQ ID NO: 977
  modified_base (17)..(30): a, c, t, g, unknown or other
  modified_base (43)..(54): a, c, t, g, unknown or other
  modified_base (67)..(95): a, c, t, g, unknown or other

SEQ ID NO: 981 - DNA, 183 bp, Homo sapiens; identical to SEQ ID NO: 979
  modified_base (17)..(30): a, c, t, g, unknown or other
  modified_base (43)..(54): a, c, t, g, unknown or other
  modified_base (67)..(95): a, c, t, g, unknown or other

SEQ ID NO: 982 - DNA, 175 bp, Homo sapiens; identical to SEQ ID NO: 975
  modified_base (17)..(30): a, c, t, g, unknown or other
  modified_base (43)..(54): a, c, t, g, unknown or other
  modified_base (67)..(95): a, c, t, g, unknown or other

SEQ ID NO: 983 - DNA, 179 bp, Homo sapiens; identical to SEQ ID NO: 977
  modified_base (17)..(30): a, c, t, g, unknown or other
  modified_base (43)..(54): a, c, t, g, unknown or other
  modified_base (67)..(95): a, c, t, g, unknown or other

SEQ ID NO: 984 - DNA, 175 bp, Homo sapiens; identical to SEQ ID NO: 975
  modified_base (17)..(30): a, c, t, g, unknown or other
  modified_base (43)..(54): a, c, t, g, unknown or other
  modified_base (67)..(95): a, c, t, g, unknown or other

SEQ ID NO: 985 - DNA, 179 bp, Homo sapiens; identical to SEQ ID NO: 977
  modified_base (17)..(30): a, c, t, g, unknown or other
  modified_base (43)..(54): a, c, t, g, unknown or other
  modified_base (67)..(95): a, c, t, g, unknown or other

SEQ ID NO: 986 - DNA, 175 bp, Homo sapiens; identical to SEQ ID NO: 975
  modified_base (17)..(30): a, c, t, g, unknown or other
  modified_base (43)..(54): a, c, t, g, unknown or other
  modified_base (67)..(95): a, c, t, g, unknown or other

SEQ ID NO: 987 - DNA, 179 bp, Homo sapiens; identical to SEQ ID NO: 977
  modified_base (17)..(30): a, c, t, g, unknown or other
  modified_base (43)..(54): a, c, t, g, unknown or other
  modified_base (67)..(95): a, c, t, g, unknown or other

SEQ ID NO: 988 - DNA, 163 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaagggaaagaaagaaagaaagaaagaaagaaagaaagaaagaaagaaa

SEQ ID NO: 989 - DNA, 167 bp, Homo sapiens
  modified_base (17)..(30): a, c, t, g, unknown or other
  modified_base (43)..(54): a, c, t, g, unknown or other
  modified_base (67)..(95): a, c, t, g, unknown or other
aaggaaggaaggaaggnnnnnnnnnnnnnnaaagaaagaaagnnnnnnnnnnnnaaagaaagaaagnnnnnnnnnnnnnnnnnnnnnnnnnnnnnaaggaaggaaggaaggaaggaagggaaagaaagaaagaaagaaagaaagaaagaaagaaagaaagaaagaaa

SEQ ID NO: 990 - DNA, 60 bp, Homo sapiens
tctgtctgtctgtctatctatctatctatctatctatctatctatctatctatctatcta

SEQ ID NO: 991 - DNA, 56 bp, Homo sapiens
tctgtctgtctgtctatctatctatctatctatctatctatctatctatctatcta

SEQ ID NO: 992 - DNA, 56 bp, Homo sapiens; identical to SEQ ID NO: 991

SEQ ID NO: 993 - DNA, 52 bp, Homo sapiens
tctgtctgtctgtctatctatctatctatctatctatctatctatctatcta

SEQ ID NO: 994 - DNA, 52 bp, Homo sapiens; identical to SEQ ID NO: 993

SEQ ID NO: 995 - DNA, 56 bp, Homo sapiens; identical to SEQ ID NO: 991

SEQ ID NO: 996 - DNA, 56 bp, Homo sapiens; identical to SEQ ID NO: 991

SEQ ID NO: 997 - DNA, 52 bp, Homo sapiens; identical to SEQ ID NO: 993

SEQ ID NO: 998 - DNA, 48 bp, Homo sapiens
tctgtctgtctgtctatctatctatctatctatctatctatctatcta

SEQ ID NO: 999 - DNA, 52 bp, Homo sapiens; identical to SEQ ID NO: 993

SEQ ID NO: 1000 - DNA, 52 bp, Homo sapiens; identical to SEQ ID NO: 993

SEQ ID NO: 1001 - DNA, 56 bp, Homo sapiens; identical to SEQ ID NO: 991

SEQ ID NO: 1002 - DNA, 52 bp, Homo sapiens; identical to SEQ ID NO: 993

SEQ ID NO: 1003 - DNA, 48 bp, Homo sapiens; identical to SEQ ID NO: 998

SEQ ID NO: 1004 - DNA, 52 bp, Homo sapiens; identical to SEQ ID NO: 993

SEQ ID NO: 1005 - DNA, 56 bp, Homo sapiens; identical to SEQ ID NO: 991

SEQ ID NO: 1006 - DNA, 56 bp, Homo sapiens; identical to SEQ ID NO: 991

SEQ ID NO: 1007 - DNA, 52 bp, Homo sapiens; identical to SEQ ID NO: 993

SEQ ID NO: 1008 - DNA, 148 bp, Homo sapiens
  modified_base (69)..(96): a, c, t, g, unknown or other
tctgtctgtctgtctgtctgtctatctatctatctatctatctatctatctatctatctatctatctannnnnnnnnnnnnnnnnnnnnnnnnnnntctgtctgtctgtctatctatctatctatctatctatctatctatctatcta

SEQ ID NO: 1009 - DNA, 144 bp, Homo sapiens
  modified_base (65)..(92): a, c, t, g, unknown or other
tctgtctgtctgtctgtctgtctatctatctatctatctatctatctatctatctatctatctannnnnnnnnnnnnnnnnnnnnnnnnnnntctgtctgtctgtctatctatctatctatctatctatctatctatctatcta

SEQ ID NO: 1010 - DNA, 160 bp, Homo sapiens
  modified_base (77)..(104): a, c, t, g, unknown or other
tctgtctgtctgtctgtctgtctatctatctatctatctatctatctatctatctatctatctatctatctatctannnnnnnnnnnnnnnnnnnnnnnnnnnntctgtctgtctgtctatctatctatctatctatctatctatctatctatctatcta

SEQ ID NO: 1011 - DNA, 156 bp, Homo sapiens
  modified_base (73)..(100): a, c, t, g, unknown or other
tctgtctgtctgtctgtctgtctatctatctatctatctatctatctatctatctatctatctatctatctannnnnnnnnnnnnnnnnnnnnnnnnnnntctgtctgtctgtctatctatctatctatctatctatctatctatctatctatcta

SEQ ID NO: 1012 - DNA, 156 bp, Homo sapiens; identical to SEQ ID NO: 1011
  modified_base (73)..(100): a, c, t, g, unknown or other

SEQ ID NO: 1013 - DNA, 152 bp, Homo sapiens
  modified_base (69)..(96): a, c, t, g, unknown or other
tctgtctgtctgtctgtctgtctatctatctatctatctatctatctatctatctatctatctatctannnnnnnnnnnnnnnnnnnnnnnnnnnntctgtctgtctgtctatctatctatctatctatctatctatctatctatctatcta

SEQ ID NO: 1014 - DNA, 148 bp, Homo sapiens; identical to SEQ ID NO: 1008
  modified_base (69)..(96): a, c, t, g, unknown or other

SEQ ID NO: 1015 - DNA, 152 bp, Homo sapiens
  modified_base (73)..(100): a, c, t, g, unknown or other
tctgtctgtctgtctgtctgtctatctatctatctatctatctatctatctatctatctatctatctatctannnnnnnnnnnnnnnnnnnnnnnnnnnntctgtctgtctgtctatctatctatctatctatctatctatctatctatcta

SEQ ID NO: 1016 - DNA, 144 bp, Homo sapiens
  modified_base (69)..(96): a, c, t, g, unknown or other
tctgtctgtctgtctgtctgtctatctatctatctatctatctatctatctatctatctatctatctannnnnnnnnnnnnnnnnnnnnnnnnnnntctgtctgtctgtctatctatctatctatctatctatctatctatcta

SEQ ID NO: 1017 - DNA, 148 bp, Homo sapiens
  modified_base (73)..(100): a, c, t, g, unknown or other
tctgtctgtctgtctgtctgtctatctatctatctatctatctatctatctatctatctatctatctatctannnnnnnnnnnnnnnnnnnnnnnnnnnntctgtctgtctgtctatctatctatctatctatctatctatctatcta

SEQ ID NO: 1018 - DNA, 148 bp, Homo sapiens; identical to SEQ ID NO: 1017
  modified_base (73)..(100): a, c, t, g, unknown or other

SEQ ID NO: 1019 - DNA, 144 bp, Homo sapiens; identical to SEQ ID NO: 1016
  modified_base (69)..(96): a, c, t, g, unknown or other

SEQ ID NO: 1020 - DNA, 100 bp, Homo sapiens
tctgtctgtctgtctgtctgtctgtctgtctgtctatctatctatctatctatctatctatctatctatctatctatctatctgtctgtctgtctgtctg

SEQ ID NO: 1021 - DNA, 96 bp, Homo sapiens
tctgtctgtctgtctgtctgtctgtctgtctgtctatctatctatctatctatctatctatctatctatctatctatctgtctgtctgtctgtctg

SEQ ID NO: 1022 - DNA, 100 bp, Homo sapiens; identical to SEQ ID NO: 1020

SEQ ID NO: 1023 - DNA, 96 bp, Homo sapiens; identical to SEQ ID NO: 1021

SEQ ID NO: 1024 - DNA, 56 bp, Homo sapiens; identical to SEQ ID NO: 991

SEQ ID NO: 1025 - DNA, 52 bp, Homo sapiens; identical to SEQ ID NO: 993

SEQ ID NO: 1026 - DNA, 52 bp, Homo sapiens; identical to SEQ ID NO: 993

SEQ ID NO: 1027 - DNA, 56 bp, Homo sapiens; identical to SEQ ID NO: 991

SEQ ID NO: 1028 - DNA, 56 bp, Homo sapiens; identical to SEQ ID NO: 991

SEQ ID NO: 1029 - DNA, 52 bp, Homo sapiens; identical to SEQ ID NO: 993

SEQ ID NO: 1030 - DNA, 56 bp, Homo sapiens; identical to SEQ ID NO: 991

SEQ ID NO: 1031 - DNA, 60 bp, Homo sapiens; identical to SEQ ID NO: 990

SEQ ID NO: 1032 - DNA, 56 bp, Homo sapiens; identical to SEQ ID NO: 991

SEQ ID NO: 1033 - DNA, 60 bp, Homo sapiens; identical to SEQ ID NO: 990

SEQ ID NO: 1034 - DNA, 39 bp, Homo sapiens
tattattattattattattattattattattattattat

SEQ ID NO: 1035 - DNA, 42 bp, Homo sapiens; identical to SEQ ID NO: 162

SEQ ID NO: 1036 - DNA, 56 bp, Homo sapiens
agatagatagatagatagatagatagatagatagatagatagatagatagatagat

SEQ ID NO: 1037 - DNA, 52 bp, Homo sapiens; identical to SEQ ID NO: 92

SEQ ID NO: 1038 - DNA, 52 bp, Homo sapiens; identical to SEQ ID NO: 92

SEQ ID NO: 1039 - DNA, 56 bp, Homo sapiens; identical to SEQ ID NO: 1036

SEQ ID NO: 1040 - DNA, 56 bp, Homo sapiens; identical to SEQ ID NO: 1036

SEQ ID NO: 1041 - DNA, 60 bp, Homo sapiens
agatagatagatagatagatagatagatagatagatagatagatagatagatagatagat

SEQ ID NO: 1042 - DNA, 39 bp, Homo sapiens
tgttgttgttgttgttgttgttgttgttgttgttgttgt

SEQ ID NO: 1043 - DNA, 36 bp, Homo sapiens
tgttgttgttgttgttgttgttgttgttgttgttgt

SEQ ID NO: 1044 - DNA, 36 bp, Homo sapiens; identical to SEQ ID NO: 1043

SEQ ID NO: 1045 - DNA, 39 bp, Homo sapiens; identical to SEQ ID NO: 1042

SEQ ID NO: 1046 - DNA, 44 bp, Homo sapiens
tggatggatggatggatggatggatggatggatggatggatgga

SEQ ID NO: 1047 - DNA, 40 bp, Homo sapiens
tggatggatggatggatggatggatggatggatggatgga

SEQ ID NO: 1048 - DNA, 56 bp, Homo sapiens
tctatctatctatctatctatctatctatctatctgtctgtctatctatctatcta

SEQ ID NO: 1049 - DNA, 60 bp, Homo sapiens
tctatctatctatctatctatctatctatctatctatctgtctgtctatctatctatcta

SEQ ID NO: 1050 - DNA, 60 bp, Homo sapiens; identical to SEQ ID NO: 1049

SEQ ID NO: 1051 - DNA, 64 bp, Homo sapiens
tctatctatctatctatctatctatctatctatctatctatctgtctgtctatctatctatcta

SEQ ID NO: 1052 - DNA, 60 bp, Homo sapiens
ttttcttttcttttcttttcttttcttttcttttcttttcttttcttttcttttcttttc

SEQ ID NO: 1053 - DNA, 50 bp, Homo sapiens
ttttcttttcttttcttttcttttcttttcttttcttttcttttcttttc

SEQ ID NO: 1054 - DNA, 60 bp, Homo sapiens; identical to SEQ ID NO: 1052

SEQ ID NO: 1055 - DNA, 84 bp, Homo sapiens
  modified_base (13)..(44): a, c, t, g, unknown or other
gatagatagatannnnnnnnnnnnnnnnnnnnnnnnnnnnnnnngatagatagatagatagatagatagatagatagatagata

SEQ ID NO: 1056 - DNA, 88 bp, Homo sapiens
  modified_base (13)..(44): a, c, t, g, unknown or other
gatagatagatannnnnnnnnnnnnnnnnnnnnnnnnnnnnnnngatagatagatagatagatagatagatagatagatagatagata

SEQ ID NO: 1057 - DNA, 96 bp, Homo sapiens
  modified_base (13)..(44): a, c, t, g, unknown or other
gatagatagatannnnnnnnnnnnnnnnnnnnnnnnnnnnnnnngatagatagatagatagatagatagatagatagatagatagatagatagata

SEQ ID NO: 1058 - DNA, 100 bp, Homo sapiens
  modified_base (13)..(44): a, c, t, g, unknown or other
gatagatagatannnnnnnnnnnnnnnnnnnnnnnnnnnnnnnngatagatagatagatagatagatagatagatagatagatagatagatagatagata

SEQ ID NO: 1059 - DNA, 96 bp, Homo sapiens; identical to SEQ ID NO: 1057
  modified_base (13)..(44): a, c, t, g, unknown or other

SEQ ID NO: 1060 - DNA, 92 bp, Homo sapiens
  modified_base (13)..(44): a, c, t, g, unknown or other
gatagatagatannnnnnnnnnnnnnnnnnnnnnnnnnnnnnnngatagatagatagatagatagatagatagatagatagatagatagata

SEQ ID NO: 1061 - DNA, 96 bp, Homo sapiens; identical to SEQ ID NO: 1057
  modified_base (13)..(44): a, c, t, g, unknown or other

SEQ ID NO: 1062 - DNA, 92 bp, Homo sapiens; identical to SEQ ID NO: 1060
  modified_base (13)..(44): a, c, t, g, unknown or other

SEQ ID NO: 1063 - DNA, 100 bp, Homo sapiens; identical to SEQ ID NO: 1058
  modified_base (13)..(44): a, c, t, g, unknown or other

SEQ ID NO: 1064 - DNA, 96 bp, Homo sapiens; identical to SEQ ID NO: 1057
  modified_base (13)..(44): a, c, t, g, unknown or other

SEQ ID NO: 1065 - DNA, 96 bp, Homo sapiens; identical to SEQ ID NO: 1057
  modified_base (13)..(44): a, c, t, g, unknown or other

SEQ ID NO: 1066 - DNA, 92 bp, Homo sapiens; identical to SEQ ID NO: 1060
  modified_base (13)..(44): a, c, t, g, unknown or other

SEQ ID NO: 1067 - DNA, 56 bp, Homo sapiens
ttccttccttccttccttccttccttccttccttccttccttccttccttccttcc

SEQ ID NO: 1068 - DNA, 60 bp, Homo sapiens
ttccttccttccttccttccttccttccttccttccttccttccttccttccttccttcc

SEQ ID NO: 1069 - DNA, 64 bp, Homo sapiens
gatagatagatagatagatagatagatagatagatagatagatagatagatagacagacagaca

SEQ ID NO: 1070 - DNA, 60 bp, Homo sapiens
gatagatagatagatagatagatagatagatagatagatagatagatagacagacagaca

SEQ ID NO: 1071 - DNA, 64 bp, Homo sapiens; identical to SEQ ID NO: 1069

SEQ ID NO: 1072 - DNA, 60 bp, Homo sapiens; identical to SEQ ID NO: 1070

SEQ ID NO: 1073 - DNA, 64 bp, Homo sapiens; identical to SEQ ID NO: 1069

SEQ ID NO: 1074 - DNA, 60 bp, Homo sapiens; identical to SEQ ID NO: 1070

SEQ ID NO: 1075 - DNA, 72 bp, Homo sapiens
gatagatagatagatagatagatagatagatagatagatagatagatagatagatagatagacagacagaca

SEQ ID NO: 1076 - DNA, 68 bp, Homo sapiens
gatagatagatagatagatagatagatagatagatagatagatagatagatagatagacagacagaca

SEQ ID NO: 1077 - DNA, 76 bp, Homo sapiens; identical to SEQ ID NO: 39

SEQ ID NO: 1078 - DNA, 72 bp, Homo sapiens; identical to SEQ ID NO: 1075

SEQ ID NO: 1079 - DNA, 68 bp, Homo sapiens; identical to SEQ ID NO: 1076

SEQ ID NO: 1080 - DNA, 64 bp, Homo sapiens; identical to SEQ ID NO: 1069

SEQ ID NO: 1081 - DNA, 72 bp, Homo sapiens; identical to SEQ ID NO: 1075

SEQ ID NO: 1082 - DNA, 68 bp, Homo sapiens; identical to SEQ ID NO: 1076

SEQ ID NO: 1083 - DNA, 68 bp, Homo sapiens; identical to SEQ ID NO: 1076

SEQ ID NO: 1084 - DNA, 72 bp, Homo sapiens; identical to SEQ ID NO: 1075

SEQ ID NO: 1085 - DNA, 64 bp, Homo sapiens; identical to SEQ ID NO: 1069

SEQ ID NO: 1086 - DNA, 60 bp, Homo sapiens; identical to SEQ ID NO: 1070

SEQ ID NO: 1087 - DNA, 60 bp, Homo sapiens; identical to SEQ ID NO: 1070

SEQ ID NO: 1088 - DNA, 56 bp, Homo sapiens
gatagatagatagatagatagatagatagatagatagatagatagacagacagaca

SEQ ID NO: 1089 - DNA, 68 bp, Homo sapiens; identical to SEQ ID NO: 1076

SEQ ID NO: 1090 - DNA, 64 bp, Homo sapiens; identical to SEQ ID NO: 1069

SEQ ID NO: 1091 - DNA, 60 bp, Homo sapiens; identical to SEQ ID NO: 1070

SEQ ID NO: 1092 - DNA, 64 bp, Homo sapiens; identical to SEQ ID NO: 1069

SEQ ID NO: 1093 - DNA, 60 bp, Homo sapiens; identical to SEQ ID NO: 1070

SEQ ID NO: 1094 - DNA, 56 bp, Homo sapiens; identical to SEQ ID NO: 1088

SEQ ID NO: 1095 - DNA, 64 bp, Homo sapiens; identical to SEQ ID NO: 1069

SEQ ID NO: 1096 - DNA, 60 bp, Homo sapiens; identical to SEQ ID NO: 1070

SEQ ID NO: 1097 - DNA, 69 bp, Homo sapiens
ttccttccttccttccttccttccttccttccttccttccttccttccttccttccttcccttcttctt

SEQ ID NO: 1098 - DNA, 65 bp, Homo sapiens
ttccttccttccttccttccttccttccttccttccttccttccttccttccttcccttcttctt

SEQ ID NO: 1099 - DNA, 65 bp, Homo sapiens; identical to SEQ ID NO: 1098

SEQ ID NO: 1100 - DNA, 69 bp, Homo sapiens; identical to SEQ ID NO: 1097

SEQ ID NO: 1101 - DNA, 65 bp, Homo sapiens; identical to SEQ ID NO: 1098

SEQ ID NO: 1102 - DNA, 69 bp, Homo sapiens; identical to SEQ ID NO: 1097

SEQ ID NO: 1103 - DNA, 48 bp, Homo sapiens
tagatagatagatagatagatagatagatagatagatagatagataga

SEQ ID NO: 1104 - DNA, 44 bp, Homo sapiens
tagatagatagatagatagatagatagatagatagatagataga

SEQ ID NO: 1105 - DNA, 52 bp, Homo sapiens; identical to SEQ ID NO: 55

SEQ ID NO: 1106 - DNA, 48 bp, Homo sapiens; identical to SEQ ID NO: 1103

SEQ ID NO: 1107 - DNA, 52 bp, Homo sapiens; identical to SEQ ID NO: 55

SEQ ID NO: 1108 - DNA, 48 bp, Homo sapiens; identical to SEQ ID NO: 1103

SEQ ID NO: 1109 - DNA, 56 bp, Homo sapiens; identical to SEQ ID NO: 111

SEQ ID NO: 1110 - DNA, 60 bp, Homo sapiens
tagatagatagatagatagatagatagatagatagatagatagatagatagatagataga

SEQ ID NO: 1111 - DNA, 60 bp, Homo sapiens; identical to SEQ ID NO: 1110

SEQ ID NO: 1112 - DNA, 56 bp, Homo sapiens; identical to SEQ ID NO: 111

SEQ ID NO: 1113 - DNA, 60 bp, Homo sapiens; identical to SEQ ID NO: 1110

SEQ ID NO: 1114 - DNA, 56 bp, Homo sapiens; identical to SEQ ID NO: 111

SEQ ID NO: 1115 - DNA, 60 bp, Homo sapiens; identical to SEQ ID NO: 1110

SEQ ID NO: 1116 - DNA, 56 bp, Homo sapiens; identical to SEQ ID NO: 111

SEQ ID NO: 1117 - DNA, 48 bp, Homo sapiens; identical to SEQ ID NO: 1103

SEQ ID NO: 1118 - DNA, 52 bp, Homo sapiens; identical to SEQ ID NO: 55

SEQ ID NO: 1119 - DNA, 52 bp, Homo sapiens; identical to SEQ ID NO: 55

SEQ ID NO: 1120 - DNA, 48 bp, Homo sapiens; identical to SEQ ID NO: 1103

SEQ ID NO: 1121 - DNA, 48 bp, Homo sapiens
tttatttatttatttatttatttatttatttatttatttatttattta

SEQ ID NO: 1122 - DNA, 44 bp, Homo sapiens; identical to SEQ ID NO: 572

SEQ ID NO: 1123 - DNA, 44 bp, Homo sapiens; identical to SEQ ID NO: 572

SEQ ID NO: 1124 - DNA, 48 bp, Homo sapiens; identical to SEQ ID NO: 1121

SEQ ID NO: 1125 - DNA, 52 bp, Homo sapiens; identical to SEQ ID NO: 136

SEQ ID NO: 1126 - DNA, 56 bp, Homo sapiens; identical to SEQ ID NO: 8

SEQ ID NO: 1127 - DNA, 65 bp, Homo sapiens
tctcttctcttctcttctcttctcttctcttctcttctcttctcttctcttctcttctcttctct

SEQ ID NO: 1128 - DNA, 70 bp, Homo sapiens
tctcttctcttctcttctcttctcttctcttctcttctcttctcttctcttctcttctcttctcttctct

SEQ ID NO: 1129 - DNA, 55 bp, Homo sapiens
tctcttctcttctcttctcttctcttctcttctcttctcttctcttctcttctct

SEQ ID NO: 1130 - DNA, 50 bp, Homo sapiens
tctcttctcttctcttctcttctcttctcttctcttctcttctcttctct

SEQ ID NO: 1131 - DNA, 60 bp, Homo sapiens
tctcttctcttctcttctcttctcttctcttctcttctcttctcttctcttctcttctct

SEQ ID NO: 1132 - DNA, 55 bp, Homo sapiens; identical to SEQ ID NO: 1129

SEQ ID NO: 1133 - DNA, 60 bp, Homo sapiens; identical to SEQ ID NO: 1131

SEQ ID NO: 1134 - DNA, 65 bp, Homo sapiens; identical to SEQ ID NO: 1127

SEQ ID NO: 1135 - DNA, 115 bp, Homo sapiens
ttatattatattatattatattatattatattattttatattatattatattatattatattatattatattatattattttatattatattatattatattatattatattata

SEQ ID NO: 1136 - DNA, 120 bp, Homo sapiens
ttatattatattatattatattatattatattattttatattatattatattatattatattatattatattatattatattattttatattatattatattatattatattatattata

SEQ ID NO: 1137 - DNA, 130 bp, Homo sapiens
ttatattatattatattatattatattatattatattattttatattatattatattatattatattatattatattatattatattatattattttatattatattatattatattatattatattata

SEQ ID NO: 1138 - DNA, 125 bp, Homo sapiens
ttatattatattatattatattatattatattatattattttatattatattatattatattatattatattatattatattatattattttatattatattatattatattatattatattata

SEQ ID NO: 1139 - DNA, 130 bp, Homo sapiens
ttatattatattatattatattatattatattattttatattatattatattatattatattatattatattatattatattattttatattatattatattatattatattatattatattatattata

SEQ ID NO: 1140 - DNA, 125 bp, Homo sapiens
ttatattatattatattatattatattatattattttatattatattatattatattatattatattatattatattatattattttatattatattatattatattatattatattatattata

SEQ ID NO: 1141 - DNA, 170 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttct

SEQ ID NO: 1142 - DNA, 166 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttct

SEQ ID NO: 1143 - DNA, 182 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttctttctttct

SEQ ID NO: 1144 - DNA, 178 bp, Homo sapiens
  modified_base (57)..(78): a, c, t, g, unknown or other
  modified_base (91)..(102): a, c, t, g, unknown or other
ttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttctttctttct

SEQ ID NO: 1145 - DNA, 178 bp, Homo sapiens
  modified_base (65)..(86): a, c, t, g, unknown or other
  modified_base (99)..(110): a, c, t, g, unknown or other
ttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttct

SEQ ID NO: 1146 - DNA, 182 bp, Homo sapiens
  modified_base (69)..(90): a, c, t, g, unknown or other
  modified_base (103)..(114): a, c, t, g, unknown or other
ttctttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttct

SEQ ID NO: 1147 - DNA, 178 bp, Homo sapiens; identical to SEQ ID NO: 1145
  modified_base (65)..(86): a, c, t, g, unknown or other
  modified_base (99)..(110): a, c, t, g, unknown or other

SEQ ID NO: 1148 - DNA, 174 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttct

SEQ ID NO: 1149 - DNA, 178 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttctttct

SEQ ID NO: 1150 - DNA, 182 bp, Homo sapiens; identical to SEQ ID NO: 1143
  modified_base (61)..(82): a, c, t, g, unknown or other
  modified_base (95)..(106): a, c, t, g, unknown or other

SEQ ID NO: 1151 - DNA, 166 bp, Homo sapiens
  modified_base (69)..(90): a, c, t, g, unknown or other
  modified_base (103)..(114): a, c, t, g, unknown or other
ttctttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttct

SEQ ID NO: 1152 - DNA, 170 bp, Homo sapiens
  modified_base (69)..(90): a, c, t, g, unknown or other
  modified_base (103)..(114): a, c, t, g, unknown or other
ttctttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttct

SEQ ID NO: 1153 - DNA, 158 bp, Homo sapiens
  modified_base (57)..(78): a, c, t, g, unknown or other
  modified_base (91)..(102): a, c, t, g, unknown or other
ttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttct

SEQ ID NO: 1154 - DNA, 162 bp, Homo sapiens
  modified_base (57)..(78): a, c, t, g, unknown or other
  modified_base (91)..(102): a, c, t, g, unknown or other
ttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttct

SEQ ID NO: 1155 - DNA, 174 bp, Homo sapiens
  modified_base (65)..(86): a, c, t, g, unknown or other
  modified_base (99)..(110): a, c, t, g, unknown or other
ttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttct

SEQ ID NO: 1156 - DNA, 178 bp, Homo sapiens; identical to SEQ ID NO: 1145
  modified_base (65)..(86): a, c, t, g, unknown or other
  modified_base (99)..(110): a, c, t, g, unknown or other

SEQ ID NO: 1157 - DNA, 178 bp, Homo sapiens; identical to SEQ ID NO: 1145
  modified_base (65)..(86): a, c, t, g, unknown or other
  modified_base (99)..(110): a, c, t, g, unknown or other

SEQ ID NO: 1158 - DNA, 182 bp, Homo sapiens
  modified_base (65)..(86): a, c, t, g, unknown or other
  modified_base (99)..(110): a, c, t, g, unknown or other
ttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttctttctttct

SEQ ID NO: 1159 - DNA, 158 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttct

SEQ ID NO: 1160 - DNA, 162 bp, Homo sapiens
  modified_base (65)..(86): a, c, t, g, unknown or other
  modified_base (99)..(110): a, c, t, g, unknown or other
ttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttct

SEQ ID NO: 1161 - DNA, 178 bp, Homo sapiens; identical to SEQ ID NO: 1149
  modified_base (61)..(82): a, c, t, g, unknown or other
  modified_base (95)..(106): a, c, t, g, unknown or other

SEQ ID NO: 1162 - DNA, 174 bp, Homo sapiens; identical to SEQ ID NO: 1148
  modified_base (61)..(82): a, c, t, g, unknown or other
  modified_base (95)..(106): a, c, t, g, unknown or other

SEQ ID NO: 1163 - DNA, 174 bp, Homo sapiens; identical to SEQ ID NO: 1148
  modified_base (61)..(82): a, c, t, g, unknown or other
  modified_base (95)..(106): a, c, t, g, unknown or other

SEQ ID NO: 1164 - DNA, 170 bp, Homo sapiens; identical to SEQ ID NO: 1141
  modified_base (61)..(82): a, c, t, g, unknown or other
  modified_base (95)..(106): a, c, t, g, unknown or other

SEQ ID NO: 1165 - DNA, 174 bp, Homo sapiens; identical to SEQ ID NO: 1155
  modified_base (65)..(86): a, c, t, g, unknown or other
  modified_base (99)..(110): a, c, t, g, unknown or other

SEQ ID NO: 1166 - DNA, 170 bp, Homo sapiens; identical to SEQ ID NO: 1141
  modified_base (61)..(82): a, c, t, g, unknown or other
  modified_base (95)..(106): a, c, t, g, unknown or other

SEQ ID NO: 1167 - DNA, 162 bp, Homo sapiens
  modified_base (61)..(82): a, c, t, g, unknown or other
  modified_base (95)..(106): a, c, t, g, unknown or other
ttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttct

SEQ ID NO: 1168 - DNA, 166 bp, Homo sapiens
  modified_base (65)..(86): a, c, t, g, unknown or other
  modified_base (99)..(110): a, c, t, g, unknown or other
ttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttct

SEQ ID NO: 1169 - DNA, 162 bp, Homo sapiens; identical to SEQ ID NO: 1167
  modified_base (61)..(82): a, c, t, g, unknown or other
  modified_base (95)..(106): a, c, t, g, unknown or other

SEQ ID NO: 1170 - DNA, 166 bp, Homo sapiens; identical to SEQ ID NO: 1168
  modified_base (65)..(86): a, c, t, g, unknown or other
  modified_base (99)..(110): a, c, t, g, unknown or other

SEQ ID NO: 1171 - DNA, 182 bp, Homo sapiens
  modified_base (73)..(94): a, c, t, g, unknown or other
  modified_base (107)..(118): a, c, t, g, unknown or other
ttctttctttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttct

SEQ ID NO: 1172 - DNA, 186 bp, Homo sapiens
  modified_base (77)..(98): a, c, t, g, unknown or other
  modified_base (111)..(122): a, c, t, g, unknown or other
ttctttctttctttctttctttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttct

SEQ ID NO: 1173 - DNA, 158 bp, Homo sapiens; identical to SEQ ID NO: 1153
  modified_base (57)..(78): a, c, t, g, unknown or other
  modified_base (91)..(102): a, c, t, g, unknown or other

SEQ ID NO: 1174 - DNA, 162 bp, Homo sapiens; identical to SEQ ID NO: 1154
  modified_base (57)..(78): a, c, t, g, unknown or other
  modified_base (91)..(102): a, c, t, g, unknown or other

SEQ ID NO: 1175 - DNA, 166 bp, Homo sapiens; identical to SEQ ID NO: 1142
  modified_base (61)..(82): a, c, t, g, unknown or other
  modified_base (95)..(106): a, c, t, g, unknown or other

SEQ ID NO: 1176 - DNA, 162 bp, Homo sapiens; identical to SEQ ID NO: 1154
  modified_base (57)..(78): a, c, t, g, unknown or other
  modified_base (91)..(102): a, c, t, g, unknown or other

SEQ ID NO: 1177 - DNA, 162 bp, Homo sapiens; identical to SEQ ID NO: 1154
  modified_base (57)..(78): a, c, t, g, unknown or other
  modified_base (91)..(102): a, c, t, g, unknown or other

SEQ ID NO: 1178 - DNA, 166 bp, Homo sapiens
  modified_base (57)..(78): a, c, t, g, unknown or other
  modified_base (91)..(102): a, c, t, g, unknown or other
ttctttctttctttctttctttctttctttctttctttctttctttctttctttctnnnnnnnnnnnnnnnnnnnnnnttctttctttctnnnnnnnnnnnnttctttctttctttctttctttctttctttctttctttctttctttctttctttctttctttct

SEQ ID NO: 1179 - DNA, 72 bp, Homo sapiens
  modified_base (46)..(57): a, c, t, g, unknown or other
ttttattttattttattttattttattttattttattttattttannnnnnnnnnnnttttattttatttta

SEQ ID NO: 1180 - DNA, 67 bp, Homo sapiens
  modified_base (41)..(52): a, c, t, g, unknown or other
ttttattttattttattttattttattttattttattttannnnnnnnnnnnttttattttatttta

SEQ ID NO: 1181 - DNA, 135 bp, Homo sapiens
  modified_base (81)..(100): a, c, t, g, unknown or other
tatactatactatactatactatactatactatactatactatactatactatactataccatactataccatactatacnnnnnnnnnnnnnnnnnnnntatactatactataccatactatactatactatac

SEQ ID NO: 1182 - DNA, 140 bp, Homo sapiens
  modified_base (86)..(105): a, c, t, g, unknown or other
tatactatactatactatactatactatactatactatactatactatactatactatactataccatactataccatactatacnnnnnnnnnnnnnnnnnnnntatactatactataccatactatactatactatac

SEQ ID NO: 1183 - DNA, 130 bp, Homo sapiens
  modified_base (76)..(95): a, c, t, g, unknown or other
tatactatactatactatactatactatactatactatactatactatactataccatactataccatactatacnnnnnnnnnnnnnnnnnnnntatactatactataccatactatactatactatac

SEQ ID NO: 1184 - DNA, 135 bp, Homo sapiens; identical to SEQ ID NO: 1181
  modified_base (81)..(100): a, c, t, g, unknown or other

SEQ ID NO: 1185 - DNA, 130 bp, Homo sapiens; identical to SEQ ID NO: 1183
  modified_base (76)..(95): a, c, t, g, unknown or other

SEQ ID NO: 1186 - DNA, 125 bp, Homo sapiens
  modified_base (71)..(90): a, c, t, g, unknown or other
tatactatactatactatactatactatactatactatactatactataccatactataccatactatacnnnnnnnnnnnnnnnnnnnntatactatactataccatactatactatactatac

SEQ ID NO: 1187 - DNA, 125 bp, Homo sapiens; identical to SEQ ID NO: 1186
  modified_base (71)..(90): a, c, t, g, unknown or other

SEQ ID NO: 1188 - DNA, 120 bp, Homo sapiens
  modified_base (66)..(85): a, c, t, g, unknown or other
tatactatactatactatactatactatactatactatactataccatactataccatactatacnnnnnnnnnnnnnnnnnnnntatactatactataccatactatactatactatac

SEQ ID NO: 1189 - DNA, 115 bp, Homo sapiens
  modified_base (61)..(80): a, c, t, g, unknown or other
tatactatactatactatactatactatactatactataccatactataccatactatacnnnnnnnnnnnnnnnnnnnntatactatactataccatactatactatactatac

SEQ ID NO: 1190 - DNA, 115 bp, Homo sapiens; identical to SEQ ID NO: 1189
  modified_base (61)..(80): a, c, t, g, unknown or other

SEQ ID NO: 1191 - DNA, 60 bp, Homo sapiens; identical to SEQ ID NO: 1041

SEQ ID NO: 1192 - DNA, 64 bp, Homo sapiens
agatagatagatagatagatagatagatagatagatagatagatagatagatagatagatagat

SEQ ID NO: 1193 - DNA, 64 bp, Homo sapiens; identical to SEQ ID NO: 1192

SEQ ID NO: 1194 - DNA, 68 bp, Homo sapiens
agatagatagatagatagatagatagatagatagatagatagatagatagatagatagatagatagat

SEQ ID NO: 1195 - DNA, 60 bp, Homo sapiens; identical to SEQ ID NO: 1041

SEQ ID NO: 1196 - DNA, 64 bp, Homo sapiens; identical to SEQ ID NO: 1192

SEQ ID NO: 1197 - DNA, 64 bp, Homo sapiens; identical to SEQ ID NO: 1192

SEQ ID NO: 1198 - DNA, 68 bp, Homo sapiens; identical to SEQ ID NO: 1194

SEQ ID NO: 1199 - DNA, 60 bp, Homo sapiens; identical to SEQ ID NO: 1041

SEQ ID NO: 1200 - DNA, 64 bp, Homo sapiens; identical to SEQ ID NO: 1192

SEQ ID NO: 1201 - DNA, 68 bp, Homo sapiens; identical to SEQ ID NO: 1194

SEQ ID NO: 1202 - DNA, 64 bp, Homo sapiens; identical to SEQ ID NO: 1192

SEQ ID NO: 1203 - DNA, 68 bp, Homo sapiens; identical to SEQ ID NO: 1194

SEQ ID NO: 1204 - DNA, 64 bp, Homo sapiens; identical to SEQ ID NO: 1192

SEQ ID NO: 1205 - DNA, 64 bp, Homo sapiens; identical to SEQ ID NO: 1192

SEQ ID NO: 1206 - DNA, 68 bp, Homo sapiens; identical to SEQ ID NO: 1194

SEQ ID NO: 1207 - DNA, 72 bp, Homo sapiens
gaaagaaagaaagaaagaaagaaagaaagaaagaaagaaagaaagaaagaaagaaagaaagaaagaaagaaa

SEQ ID NO: 1208 - DNA, 68 bp, Homo sapiens
gaaagaaagaaagaaagaaagaaagaaagaaagaaagaaagaaagaaagaaagaaagaaagaaagaaa

SEQ ID NO: 1209 - DNA, 72 bp, Homo sapiens; identical to SEQ ID NO: 1207

SEQ ID NO: 1210 - DNA, 76 bp, Homo sapiens
gaaagaaagaaagaaagaaagaaagaaagaaagaaagaaagaaagaaagaaagaaagaaagaaagaaagaaagaaa

SEQ ID NO: 1211 - DNA, 68 bp, Homo sapiens; identical to SEQ ID NO: 1208

SEQ ID NO: 1212 - DNA, 72 bp, Homo sapiens; identical to SEQ ID NO: 1207

SEQ ID NO: 1213 - DNA, 68 bp, Homo sapiens; identical to SEQ ID NO: 1208

SEQ ID NO: 1214 - DNA, 72 bp, Homo sapiens; identical to SEQ ID NO: 1207

SEQ ID NO: 1215 - DNA, 64 bp, Homo sapiens
gaaagaaagaaagaaagaaagaaagaaagaaagaaagaaagaaagaaagaaagaaagaaagaaa

SEQ ID NO: 1216 - DNA, 60 bp, Homo sapiens
gaaagaaagaaagaaagaaagaaagaaagaaagaaagaaagaaagaaagaaagaaagaaa

SEQ ID NO: 1217 - DNA, 68 bp, Homo sapiens; identical to SEQ ID NO: 1208

SEQ ID NO: 1218 - DNA, 72 bp, Homo sapiens; identical to SEQ ID NO: 1207

SEQ ID NO: 1219 - DNA, 60 bp, Homo sapiens; identical to SEQ ID NO: 1216

SEQ ID NO: 1220 - DNA, 64 bp, Homo sapiens; identical to SEQ ID NO: 1215

SEQ ID NO: 1221 - DNA, 64 bp, Homo sapiens; identical to SEQ ID NO: 1215

SEQ ID NO: 1222 - DNA, 60 bp, Homo sapiens; identical to SEQ ID NO: 1216

SEQ ID NO: 1223 - DNA, 68 bp, Homo sapiens; identical to SEQ ID NO: 1208

SEQ ID NO: 1224 - DNA, 64 bp, Homo sapiens; identical to SEQ ID NO: 1215

SEQ ID NO: 1225 - DNA, 64 bp, Homo sapiens; identical to SEQ ID NO: 1215

SEQ ID NO: 1226 - DNA, 68 bp, Homo sapiens; identical to SEQ ID NO: 1208

SEQ ID NO: 1227 - DNA, 68 bp, Homo sapiens; identical to SEQ ID NO: 1208

SEQ ID NO: 1228 - DNA, 64 bp, Homo sapiens; identical to SEQ ID NO: 1215

SEQ ID NO: 1229 - DNA, 68 bp, Homo sapiens; identical to SEQ ID NO: 1208

SEQ ID NO: 1230 - DNA, 64 bp, Homo sapiens; identical to SEQ ID NO: 1215

SEQ ID NO: 1231 - DNA, 72 bp, Homo sapiens; identical to SEQ ID NO: 1207

SEQ ID NO: 1232 - DNA, 68 bp, Homo sapiens; identical to SEQ ID NO: 1208

SEQ ID NO: 1233 - DNA, 72 bp, Homo sapiens; identical to SEQ ID NO: 1207

SEQ ID NO: 1234 - DNA, 76 bp, Homo sapiens; identical to SEQ ID NO: 1210

SEQ ID NO: 1235 - DNA, 40 bp, Homo sapiens
atttatttatttatttatttatttatttatttatttattt

SEQ ID NO: 1236 - DNA, 36 bp, Homo sapiens
atttatttatttatttatttatttatttatttattt

SEQ ID NO: 1237 - DNA, 36 bp, Homo sapiens; identical to SEQ ID NO: 1236

SEQ ID NO: 1238 - DNA, 40 bp, Homo sapiens; identical to SEQ ID NO: 1235

SEQ ID NO: 1239 - DNA, 40 bp, Homo sapiens; identical to SEQ ID NO: 1235

SEQ ID NO: 1240 - DNA, 36 bp, Homo sapiens; identical to SEQ ID NO: 1236

SEQ ID NO: 1241 - DNA, 40 bp, Homo sapiens; identical to SEQ ID NO: 1235

SEQ ID NO: 1242 - DNA, 44 bp, Homo sapiens; identical to SEQ ID NO: 51

SEQ ID NO: 1243 - DNA, 52 bp, Homo sapiens; identical to SEQ ID NO: 55

SEQ ID NO: 1244 - DNA, 48 bp, Homo sapiens; identical to SEQ ID NO: 1103

SEQ ID NO: 1245 - DNA, 36 bp, Homo sapiens
tagatagatagatagatagatagatagatagataga

SEQ ID NO: 1246 - DNA, 40 bp, Homo sapiens
tagatagatagatagatagatagatagatagatagataga

SEQ ID NO: 1247 - DNA, 44 bp, Homo sapiens; identical to SEQ ID NO: 1104

SEQ ID NO: 1248 - DNA, 40 bp, Homo sapiens; identical to SEQ ID NO: 1246

SEQ ID NO: 1249 - DNA, 48 bp, Homo sapiens; identical to SEQ ID NO: 1103

SEQ ID NO: 1250 - DNA, 44 bp, Homo sapiens; identical to SEQ ID NO: 1104

SEQ ID NO: 1251 - DNA, 44 bp, Homo sapiens; identical to SEQ ID NO: 1104

SEQ ID NO: 1252 - DNA, 40 bp, Homo sapiens; identical to SEQ ID NO: 1246

SEQ ID NO: 1253 - DNA, 44 bp, Homo sapiens; identical to SEQ ID NO: 1104

SEQ ID NO: 1254 - DNA, 40 bp, Homo sapiens; identical to SEQ ID NO: 1246

SEQ ID NO: 1255 - DNA, 48 bp, Homo sapiens; identical to SEQ ID NO: 1103

SEQ ID NO: 1256 - DNA, 44 bp, Homo sapiens; identical to SEQ ID NO: 1104

SEQ ID NO: 1257 - DNA, 44 bp, Homo sapiens; identical to SEQ ID NO: 1104

SEQ ID NO: 1258 - DNA, 40 bp, Homo sapiens; identical to SEQ ID NO: 1246

SEQ ID NO: 1259 - DNA, 40 bp, Homo sapiens; identical to SEQ ID NO: 1246

SEQ ID NO: 1260 - DNA, 44 bp, Homo sapiens; identical to SEQ ID NO: 1104

SEQ ID NO: 1261 - DNA, 52 bp, Homo sapiens; identical to SEQ ID NO: 55

SEQ ID NO: 1262 - DNA, 48 bp, Homo sapiens; identical to SEQ ID NO: 1103

SEQ ID NO: 1263 - DNA, 44 bp, Homo sapiens; identical to SEQ ID NO: 1104

SEQ ID NO: 1264 - DNA, 40 bp, Homo sapiens; identical to SEQ ID NO: 1246

SEQ ID NO: 1265 - DNA, 44 bp, Homo sapiens
catacatacatacatacatacatacatacatacatacatacata

SEQ ID NO: 1266 - DNA, 40 bp, Homo sapiens
catacatacatacatacatacatacatacatacatacata

SEQ ID NO: 1267 - DNA, 52 bp, Homo sapiens
catacatacatacatacatacatacatacatacatacatacatacatacata

SEQ ID NO: 1268 - DNA, 48 bp, Homo sapiens
catacatacatacatacatacatacatacatacatacatacatacata

SEQ ID NO: 1269 - DNA, 44 bp, Homo sapiens; identical to SEQ ID NO: 1265

SEQ ID NO: 1270 - DNA, 40 bp, Homo sapiens; identical to SEQ ID NO: 1266

SEQ ID NO: 1271 - DNA, 44 bp, Homo sapiens; identical to SEQ ID NO: 1265

SEQ ID NO: 1272 - DNA, 48 bp, Homo sapiens; identical to SEQ ID NO: 1268

SEQ ID NO: 1273 - DNA, 105 bp, Homo sapiens
aaaggaaaggaaaggaaaggaaaggaaaggaagggaagggaagggaagggaagggaagggaagggaagggaagggaagggaagggaagggaagggaagggaaggg

SEQ ID NO: 1274 - DNA, 110 bp, Homo sapiens
aaaggaaaggaaaggaaaggaaaggaaaggaagggaagggaagggaagggaagggaagggaagggaagggaagggaagggaagggaagggaagggaagggaagggaaggg

SEQ ID NO: 1275 - DNA, 95 bp, Homo sapiens
aaaggaaaggaaaggaaaggaaaggaaaggaagggaagggaagggaagggaagggaagggaagggaagggaagggaagggaagggaagggaaggg

SEQ ID NO: 1276 - DNA, 100 bp, Homo sapiens
aaaggaaaggaaaggaaaggaaaggaaaggaagggaagggaagggaagggaagggaagggaagggaagggaagggaagggaagggaagggaagggaaggg

SEQ ID NO: 1277 - DNA, 146 bp, Homo sapiens
  modified_base (65)..(110): a, c, t, g, unknown or other
  modified_base (123)..(130): a, c, t, g, unknown or other
ccttccttccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1278 - DNA, 150 bp, Homo sapiens
  modified_base (69)..(114): a, c, t, g, unknown or other
  modified_base (127)..(134): a, c, t, g, unknown or other
ccttccttccttccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1279 - DNA, 142 bp, Homo sapiens
  modified_base (61)..(106): a, c, t, g, unknown or other
  modified_base (119)..(126): a, c, t, g, unknown or other
ccttccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1280 - DNA, 138 bp, Homo sapiens
  modified_base (57)..(102): a, c, t, g, unknown or other
  modified_base (115)..(122): a, c, t, g, unknown or other
ccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1281 - DNA, 150 bp, Homo sapiens; identical to SEQ ID NO: 1278
  modified_base (69)..(114): a, c, t, g, unknown or other
  modified_base (127)..(134): a, c, t, g, unknown or other

SEQ ID NO: 1282 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1283 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1284 - DNA, 158 bp, Homo sapiens
  modified_base (77)..(122): a, c, t, g, unknown or other
  modified_base (135)..(142): a, c, t, g, unknown or other
ccttccttccttccttccttccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1285 - DNA, 134 bp, Homo sapiens
  modified_base (53)..(98): a, c, t, g, unknown or other
  modified_base (111)..(118): a, c, t, g, unknown or other
ccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1286 - DNA, 138 bp, Homo sapiens; identical to SEQ ID NO: 1280
  modified_base (57)..(102): a, c, t, g, unknown or other
  modified_base (115)..(122): a, c, t, g, unknown or other

SEQ ID NO: 1287 - DNA, 154 bp, Homo sapiens
  modified_base (73)..(118): a, c, t, g, unknown or other
  modified_base (131)..(138): a, c, t, g, unknown or other
ccttccttccttccttccttccttccttccttccttccttccttccttccttccttccttccttccttccttnnnnnnnnnnnnnnnnnnnnnnnnnnnnnnnnnnnnnnnnnnnnnnccttccttccttnnnnnnnnccttccttccttcctt

SEQ ID NO: 1288 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1289 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1290 - DNA, 142 bp, Homo sapiens; identical to SEQ ID NO: 1279
  modified_base (61)..(106): a, c, t, g, unknown or other
  modified_base (119)..(126): a, c, t, g, unknown or other

SEQ ID NO: 1291 - DNA, 150 bp, Homo sapiens; identical to SEQ ID NO: 1278
  modified_base (69)..(114): a, c, t, g, unknown or other
  modified_base (127)..(134): a, c, t, g, unknown or other

SEQ ID NO: 1292 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1293 - DNA, 142 bp, Homo sapiens; identical to SEQ ID NO: 1279
  modified_base (61)..(106): a, c, t, g, unknown or other
  modified_base (119)..(126): a, c, t, g, unknown or other

SEQ ID NO: 1294 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1295 - DNA, 154 bp, Homo sapiens; identical to SEQ ID NO: 1287
  modified_base (73)..(118): a, c, t, g, unknown or other
  modified_base (131)..(138): a, c, t, g, unknown or other

SEQ ID NO: 1296 - DNA, 158 bp, Homo sapiens; identical to SEQ ID NO: 1284
  modified_base (77)..(122): a, c, t, g, unknown or other
  modified_base (135)..(142): a, c, t, g, unknown or other

SEQ ID NO: 1297 - DNA, 150 bp, Homo sapiens; identical to SEQ ID NO: 1278
  modified_base (69)..(114): a, c, t, g, unknown or other
  modified_base (127)..(134): a, c, t, g, unknown or other

SEQ ID NO: 1298 - DNA, 146 bp, Homo sapiens; identical to SEQ ID NO: 1277
  modified_base (65)..(110): a, c, t, g, unknown or other
  modified_base (123)..(130): a, c, t, g, unknown or other

SEQ ID NO: 1299 - DNA, 154 bp, Homo sapiens; identical to SEQ ID NO: 1287
  modified_base (73)..(118): a, c, t, g, unknown or other
  modified_base (131)..(138): a, c, t, g, unknown or other

SEQ ID NO: 1300 - DNA, 150 bp, Homo sapiens; identical to SEQ ID NO: 1278
  modified_base (69)..(114): a, c, t, g, unknown or other
  modified_base (127)..(134): a, c, t, g, unknown or other

SEQ ID NO: 1301 - DNA, 253 bp, Homo sapiens
  modified_base (13)..(56): a, c, t, g, unknown or other
  modified_base (66)..(105): a, c, t, g, unknown or other
  modified_base (115)..(149): a, c, t, g, unknown or other
  modified_base (162)..(169): a, c, t, g, unknown or other
ctgctgctgctgnnnnnnnnnnnnnnnnnnnnnnnnnnnnnnnnnnnnnnnnnnnncctcctcctnnnnnnnnnnnnnnnnnnnnnnnnnnnnnnnnnnnnnnnncttcttcttnnnnnnnnnnnnnnnnnnnnnnnnnnnnnnnnnnncctcctcctcctnnnnnnnnctcctcctcctccttcttcttcttcttcttcttcttattcatattcatattcatattcatattcatattcatattcatattcat

SEQ ID NO: 1302 - DNA, 256 bp, Homo sapiens
  modified_base (13)..(56): a, c, t, g, unknown or other
  modified_base (66)..(105): a, c, t, g, unknown or other
  modified_base (115)..(149): a, c, t, g, unknown or other
  modified_base (162)..(169): a, c, t, g, unknown or other
ctgctgctgctgnnnnnnnnnnnnnnnnnnnnnnnnnnnnnnnnnnnnnnnnnnnncctcctcctnnnnnnnnnnnnnnnnnnnnnnnnnnnnnnnnnnnnnnnncttcttcttnnnnnnnnnnnnnnnnnnnnnnnnnnnnnnnnnnncctcctcctcctnnnnnnnnctcctcctcctccttcttcttcttcttcttcttcttcttattcatattcatattcatattcatattcatattcatattcatattcat

SEQ ID NO: 1303 - DNA, 262 bp, Homo sapiens
  modified_base (13)..(56): a, c, t, g, unknown or other
  modified_base (66)..(105): a, c, t, g, unknown or other
  modified_base (115)..(149): a, c, t, g, unknown or other
  modified_base (162)..(169): a, c, t, g, unknown or other
ctgctgctgctgnnnnnnnnnnnnnnnnnnnnnnnnnnnnnnnnnnnnnnnnnnnncctcctcctnnnnnnnnnnnnnnnnnnnnnnnnnnnnnnnnnnnnnnnncttcttcttnnnnnnnnnnnnnnnnnnnnnnnnnnnnnnnnnnncctcctcctcctnnnnnnnnctcctcctcctccttcttcttcttcttcttcttcttcttattcatattcatattcatattcatattcatattcatattcatattcatattcat

SEQ ID NO: 1304 - DNA, 256 bp, Homo sapiens; identical to SEQ ID NO: 1302
  modified_base (13)..(56): a, c, t, g, unknown or other
  modified_base (66)..(105): a, c, t, g, unknown or other
  modified_base (115)..(149): a, c, t, g, unknown or other
  modified_base (162)..(169): a, c, t, g, unknown or other

SEQ ID NO: 1305 - DNA, 322 bp, Homo sapiens
  modified_base (10)..(48): a, c, t, g, unknown or other
  modified_base (134)..(150): a, c, t, g, unknown or other
  modified_base (166)..(202): a, c, t, g, unknown or other
  modified_base (212)..(223): a, c, t, g, unknown or other
  modified_base (236)..(247): a, c, t, g, unknown or other
  modified_base (257)..(268): a, c, t, g, unknown or other
  modified_base (296)..(304): a, c, t, g, unknown or other
cttcttcttnnnnnnnnnnnnnnnnnnnnnnnnnnnnnnnnnnnnnnncttcttcttcttgttcttcttcttcttcttcttcttcttcttcttcttcttcttcttcttcttcttcttcttctttcttcttcttnnnnnnnnnnnnnnnnncttcttcttcttcttnnnnnnnnnnnnnnnnnnnnnnnnnnnnnnnnnnnnncttcttcttnnnnnnnnnnnncttcttcttcttnnnnnnnnnnnncttcttcttnnnnnnnnnnnncttcttcttcttcttcctcctcctcctnnnnnnnnncttcttcttcctcctcct

SEQ ID NO: 1306 - DNA, 325 bp, Homo sapiens
  modified_base (10)..(48): a, c, t, g, unknown or other
  modified_base (137)..(153): a, c, t, g, unknown or other
  modified_base (169)..(205): a, c, t, g, unknown or other
  modified_base (215)..(226): a, c, t, g, unknown or other
  modified_base (239)..(250): a, c, t, g, unknown or other
  modified_base (260)..(271): a, c, t, g, unknown or other
  modified_base (299)..(307): a, c, t, g, unknown or other
cttcttcttnnnnnnnnnnnnnnnnnnnnnnnnnnnnnnnnnnnnnnncttcttcttcttgttcttcttcttcttcttcttcttcttcttcttcttcttcttcttcttcttcttcttcttcttctttcttcttcttnnnnnnnnnnnnnnnnncttcttcttcttcttnnnnnnnnnnnnnnnnnnnnnnnnnnnnnnnnnnnnncttcttcttnnnnnnnnnnnncttcttcttcttnnnnnnnnnnnncttcttcttnnnnnnnnnnnncttcttcttcttcttcctcctcctcctnnnnnnnnncttcttcttcctcctcct

SEQ ID NO: 1307 - DNA, 307 bp, Homo sapiens
  modified_base (10)..(48): a, c, t, g, unknown or other
  modified_base (119)..(135): a, c, t, g, unknown or other
  modified_base (151)..(187): a, c, t, g, unknown or other
  modified_base (197)..(208): a, c, t, g, unknown or other
  modified_base (221)..(232): a, c, t, g, unknown or other
  modified_base (242)..(253): a, c, t, g, unknown or other
  modified_base (281)..(289): a, c, t, g, unknown or other
cttcttcttnnnnnnnnnnnnnnnnnnnnnnnnnnnnnnnnnnnnnnncttcttcttcttgttcttcttcttcttcttcttcttcttcttcttcttcttcttcttctttcttcttcttnnnnnnnnnnnnnnnnncttcttcttcttcttnnnnnnnnnnnnnnnnnnnnnnnnnnnnnnnnnnnnncttcttcttnnnnnnnnnnnncttcttcttcttnnnnnnnnnnnncttcttcttnnnnnnnnnnnncttcttcttcttcttcctcctcctcctnnnnnnnnncttcttcttcctcctcct

SEQ ID NO: 1308 - DNA, 310 bp, Homo sapiens
  modified_base (10)..(48): a, c, t, g, unknown or other
  modified_base (122)..(138): a, c, t, g, unknown or other
  modified_base (154)..(190): a, c, t, g, unknown or other
  modified_base (200)..(211): a, c, t, g, unknown or other
  modified_base (224)..(235): a, c, t, g, unknown or other
  modified_base (245)..(256): a, c, t, g, unknown or other
  modified_base (284)..(292): a, c, t, g, unknown or other
cttcttcttnnnnnnnnnnnnnnnnnnnnnnnnnnnnnnnnnnnnnnncttcttcttcttgttcttcttcttcttcttcttcttcttcttcttcttcttcttcttcttctttcttcttcttnnnnnnnnnnnnnnnnncttcttcttcttcttnnnnnnnnnnnnnnnnnnnnnnnnnnnnnnnnnnnnncttcttcttnnnnnnnnnnnncttcttcttcttnnnnnnnnnnnncttcttcttnnnnnnnnnnnncttcttcttcttcttcctcctcctcctnnnnnnnnncttcttcttcctcctcct

SEQ ID NO: 1309 - DNA, 307 bp, Homo sapiens; identical to SEQ ID NO: 1307
  modified_base (10)..(48): a, c, t, g, unknown or other
  modified_base (119)..(135): a, c, t, g, unknown or other
  modified_base (151)..(187): a, c, t, g, unknown or other
  modified_base (197)..(208): a, c, t, g, unknown or other
  modified_base (221)..(232): a, c, t, g, unknown or other
  modified_base (242)..(253): a, c, t, g, unknown or other
  modified_base (281)..(289): a, c, t, g, unknown or other

SEQ ID NO: 1310 - DNA, 310 bp, Homo sapiens; identical to SEQ ID NO: 1308
  modified_base (10)..(48): a, c, t, g, unknown or other
  modified_base (122)..(138): a, c, t, g, unknown or other
  modified_base (154)..(190): a, c, t, g, unknown or other
  modified_base (200)..(211): a, c, t, g, unknown or other
  modified_base (224)..(235): a, c, t, g, unknown or other
  modified_base (245)..(256): a, c, t, g, unknown or other
  modified_base (284)..(292): a, c, t, g, unknown or other

SEQ ID NO: 1311 - DNA, 310 bp, Homo sapiens; identical to SEQ ID NO: 1308
  modified_base (10)..(48): a, c, t, g, unknown or other
  modified_base (122)..(138): a, c, t, g, unknown or other
  modified_base (154)..(190): a, c, t, g, unknown or other
  modified_base (200)..(211): a, c, t, g, unknown or other
  modified_base (224)..(235): a, c, t, g, unknown or other
  modified_base (245)..(256): a, c, t, g, unknown or other
  modified_base (284)..(292): a, c, t, g, unknown or other

SEQ ID NO: 1312 - DNA, 307 bp, Homo sapiens; identical to SEQ ID NO: 1307
  modified_base (10)..(48): a, c, t, g, unknown or other
  modified_base (119)..(135): a, c, t, g, unknown or other
  modified_base (151)..(187): a, c, t, g, unknown or other
  modified_base (197)..(208): a, c, t, g, unknown or other
  modified_base (221)..(232): a, c, t, g, unknown or other
  modified_base (242)..(253): a, c, t, g, unknown or other
  modified_base (281)..(289): a, c, t, g, unknown or other

SEQ ID NO: 1313 - DNA, 33 bp, Homo sapiens
tgatgatgatgatgatgatgatgatgatgatga

SEQ ID NO: 1314 - DNA, 36 bp, Homo sapiens
tgatgatgatgatgatgatgatgatgatgatgatga

SEQ ID NO: 1315 - DNA, 84 bp, Homo sapiens
cttcttcttcttcttcttcttcttcttcttcttcttcttcttcttcttcttcttcttcttcttcttcttcttcttcttcttctt

SEQ ID NO: 1316 - DNA, 87 bp, Homo sapiens
cttcttcttcttcttcttcttcttcttcttcttcttcttcttcttcttcttcttcttcttcttcttcttcttcttcttcttcttctt

SEQ ID NO: 1317 - DNA, 66 bp, Homo sapiens
cttcttcttcttcttcttcttcttcttcttcttcttcttcttcttcttcttcttcttcttcttctt

SEQ ID NO: 1318 - DNA, 69 bp, Homo sapiens
cttcttcttcttcttcttcttcttcttcttcttcttcttcttcttcttcttcttcttcttcttcttctt

SEQ ID NO: 1319 - DNA, 90 bp, Homo sapiens
cttcttcttcttcttcttcttcttcttcttcttcttcttcttcttcttcttcttcttcttcttcttcttcttcttcttcttcttcttctt

SEQ ID NO: 1320 - DNA, 87 bp, Homo sapiens; identical to SEQ ID NO: 1316

SEQ ID NO: 1321 - DNA, 96 bp, Homo sapiens; identical to SEQ ID NO: 71

SEQ ID NO: 1322 - DNA, 93 bp, Homo sapiens
cttcttcttcttcttcttcttcttcttcttcttcttcttcttcttcttcttcttcttcttcttcttcttcttcttcttcttcttcttcttctt

SEQ ID NO: 1323 - DNA, 93 bp, Homo sapiens; identical to SEQ ID NO: 1322

SEQ ID NO: 1324 - DNA, 90 bp, Homo sapiens; identical to SEQ ID NO: 1319

SEQ ID NO: 1325 - DNA, 69 bp, Homo sapiens; identical to SEQ ID NO: 1318

SEQ ID NO: 1326 - DNA, 63 bp, Homo sapiens
cttcttcttcttcttcttcttcttcttcttcttcttcttcttcttcttcttcttcttcttctt

SEQ ID NO: 1327 - DNA, 75 bp, Homo sapiens
cttcttcttcttcttcttcttcttcttcttcttcttcttcttcttcttcttcttcttcttcttcttcttcttctt

SEQ ID NO: 1328 - DNA, 72 bp, Homo sapiens
cttcttcttcttcttcttcttcttcttcttcttcttcttcttcttcttcttcttcttcttcttcttcttctt

SEQ ID NO: 1329 - DNA, 66 bp, Homo sapiens; identical to SEQ ID NO: 1317

SEQ ID NO: 1330 - DNA, 69 bp, Homo sapiens; identical to SEQ ID NO: 1318

SEQ ID NO: 1331 - DNA, 69 bp, Homo sapiens
  modified_base (40)..(51): a, c, t, g, unknown or other
aataataataataataataataataataataataataatnnnnnnnnnnnnaataataattattattat

SEQ ID NO: 1332 - DNA, 63 bp, Homo sapiens
  modified_base (34)..(45): a, c, t, g, unknown or other
aataataataataataataataataataataatnnnnnnnnnnnnaataataattattattat

SEQ ID NO: 1333 - DNA, 69 bp, Homo sapiens; identical to SEQ ID NO: 1331
  modified_base (40)..(51): a, c, t, g, unknown or other

SEQ ID NO: 1334 - DNA, 72 bp, Homo sapiens
  modified_base (43)..(54): a, c, t, g, unknown or other
aataataataataataataataataataataataataataatnnnnnnnnnnnnaataataattattattat

SEQ ID NO: 1335 - DNA, 66 bp, Homo sapiens
  modified_base (37)..(48): a, c, t, g, unknown or other
aataataataataataataataataataataataatnnnnnnnnnnnnaataataattattattat

SEQ ID NO: 1336 - DNA, 69 bp, Homo sapiens; identical to SEQ ID NO: 1331
  modified_base (40)..(51): a, c, t, g, unknown or other

SEQ ID NO: 1337 - DNA, 66 bp, Homo sapiens; identical to SEQ ID NO: 1335
  modified_base (37)..(48): a, c, t, g, unknown or other

SEQ ID NO: 1338 - DNA, 60 bp, Homo sapiens
  modified_base (31)..(42): a, c, t, g, unknown or other
aataataataataataataataataataatnnnnnnnnnnnnaataataattattattat

SEQ ID NO: 1339 - DNA, 39 bp, Homo sapiens; identical to SEQ ID NO: 531

SEQ ID NO: 1340 - DNA, 42 bp, Homo sapiens; identical to SEQ ID NO: 532

SEQ ID NO: 1341 - DNA, 42 bp, Homo sapiens; identical to SEQ ID NO: 532

SEQ ID NO: 1342 - DNA, 39 bp, Homo sapiens; identical to SEQ ID NO: 531

SEQ ID NO: 1343 - DNA, 45 bp, Homo sapiens; identical to SEQ ID NO: 536

SEQ ID NO: 1344 - DNA, 48 bp, Homo sapiens; identical to SEQ ID NO: 5

SEQ ID NO: 1345 - DNA, 45 bp, Homo sapiens; identical to SEQ ID NO: 536

SEQ ID NO: 1346 - DNA, 48 bp, Homo sapiens; identical to SEQ ID NO: 5

SEQ ID NO: 1347 - DNA, 51 bp, Homo sapiens
aataataataataataataataataataataataataataataataataat

SEQ ID NO: 1348 - DNA, 48 bp, Homo sapiens; identical to SEQ ID NO: 5

SEQ ID NO: 1349 - DNA, 45 bp, Homo sapiens; identical to SEQ ID NO: 76

SEQ ID NO: 1350 - DNA, 42 bp, Homo sapiens
ttattattattattattattattattattattattattatta

SEQ ID NO: 1351 - DNA, 45 bp, Homo sapiens; identical to SEQ ID NO: 76

SEQ ID NO: 1352 - DNA, 48 bp, Homo sapiens; identical to SEQ ID NO: 77

SEQ ID NO: 1353 - DNA, 87 bp, Homo sapiens
  modified_base (69)..(75): a, c, t, g, unknown or other
ccttccttccttccttccttccttccttccttccttccttccttccttccttccttccttccttccttnnnnnnnccctccctccct

SEQ ID NO: 1354 - DNA, 83 bp, Homo sapiens
  modified_base (65)..(71): a, c, t, g, unknown or other
ccttccttccttccttccttccttccttccttccttccttccttccttccttccttccttccttnnnnnnnccctccctccct

SEQ ID NO: 1355 - DNA, 95 bp, Homo sapiens
  modified_base (77)..(83): a, c, t, g, unknown or other
ccttccttccttccttccttccttccttccttccttccttccttccttccttccttccttccttccttccttccttnnnnnnnccctccctccct

SEQ ID NO: 1356 - DNA, 91 bp, Homo sapiens
  modified_base (73)..(79): a, c, t, g, unknown or other
ccttccttccttccttccttccttccttccttccttccttccttccttccttccttccttccttccttccttnnnnnnnccctccctccct

SEQ ID NO: 1357 - DNA, 87 bp, Homo sapiens; identical to SEQ ID NO: 1353
  modified_base (69)..(75): a, c, t, g, unknown or other

SEQ ID NO: 1358 - DNA, 91 bp, Homo sapiens; identical to SEQ ID NO: 1356
  modified_base (73)..(79): a, c, t, g, unknown or other

SEQ ID NO: 1359 - DNA, 91 bp, Homo sapiens; identical to SEQ ID NO: 1356
  modified_base (73)..(79): a, c, t, g, unknown or other

SEQ ID NO: 1360 - DNA, 87 bp, Homo sapiens; identical to SEQ ID NO: 1353
  modified_base (69)..(75): a, c, t, g, unknown or other

SEQ ID NO: 1361 - DNA, 91 bp, Homo sapiens; identical to SEQ ID NO: 1356
  modified_base (73)..(79): a, c, t, g, unknown or other

SEQ ID NO: 1362 - DNA, 87 bp, Homo sapiens; identical to SEQ ID NO: 1353
  modified_base (69)..(75): a, c, t, g, unknown or other

SEQ ID NO: 1363 - DNA, 52 bp, Homo sapiens
tccttccttccttccttccttccttccttccttccttccttccttccttcct

SEQ ID NO: 1364 - DNA, 48 bp, Homo sapiens
tccttccttccttccttccttccttccttccttccttccttccttcct

SEQ ID NO: 1365 - DNA, 48 bp, Homo sapiens; identical to SEQ ID NO: 1364

SEQ ID NO: 1366 - DNA, 52 bp, Homo sapiens; identical to SEQ ID NO: 1363

SEQ ID NO: 1367 - DNA, 40 bp, Homo sapiens; identical to SEQ ID NO: 945

SEQ ID NO: 1368 - DNA, 44 bp, Homo sapiens; identical to SEQ ID NO: 943

SEQ ID NO: 1369 - DNA, 44 bp, Homo sapiens; identical to SEQ ID NO: 943

SEQ ID NO: 1370 - DNA, 48 bp, Homo sapiens; identical to SEQ ID NO: 171

SEQ ID NO: 1371 - DNA, 44 bp, Homo sapiens; identical to SEQ ID NO: 943

SEQ ID NO: 1372 - DNA, 40 bp, Homo sapiens; identical to SEQ ID NO: 945

SEQ ID NO: 1373 - DNA, 56 bp, Homo sapiens; identical to SEQ ID NO: 18

SEQ ID NO: 1374 - DNA, 52 bp, Homo sapiens; identical to SEQ ID NO: 947

SEQ ID NO: 1375 - DNA, 57 bp, Homo sapiens
aaataaataaataaataaataaataaataaataaataaataataaaaataaataaat

SEQ ID NO: 1376 - DNA, 53 bp, Homo sapiens
aaataaataaataaataaataaataaataaataaataataaaaataaataaat

SEQ ID NO: 1377 - DNA, 122 bp, Homo sapiens
  modified_base (13)..(24): a, c, t, g, unknown or other
  modified_base (73)..(85): a, c, t, g, unknown or other
  modified_base (102)..(110): a, c, t, g, unknown or other
gatagatagatannnnnnnnnnnngatagatagatagatagatagatagatagatagatagatagatagatannnnnnnnnnnnnggatggatggatggatnnnnnnnnngatagatagata

SEQ ID NO: 1378 - DNA, 126 bp, Homo sapiens
  modified_base (13)..(24): a, c, t, g, unknown or other
  modified_base (77)..(89): a, c, t, g, unknown or other
  modified_base (106)..(114): a, c, t, g, unknown or other
gatagatagatannnnnnnnnnnngatagatagatagatagatagatagatagatagatagatagatagatagatannnnnnnnnnnnnggatggatggatggatnnnnnnnnngatagatagata

SEQ ID NO: 1379 - DNA, 122 bp, Homo sapiens; identical to SEQ ID NO: 1377
  modified_base (13)..(24): a, c, t, g, unknown or other
  modified_base (73)..(85): a, c, t, g, unknown or other
  modified_base (102)..(110): a, c, t, g, unknown or other

SEQ ID NO: 1380 - DNA, 118 bp, Homo sapiens
  modified_base (13)..(24): a, c, t, g, unknown or other
  modified_base (69)..(81): a, c, t, g, unknown or other
  modified_base (98)..(106): a, c, t, g, unknown or other
gatagatagatannnnnnnnnnnngatagatagatagatagatagatagatagatagatagatagatannnnnnnnnnnnnggatggatggatggatnnnnnnnnngatagatagata

SEQ ID NO: 1381 - DNA, 122 bp, Homo sapiens; identical to SEQ ID NO: 1377
  modified_base (13)..(24): a, c, t, g, unknown or other
  modified_base (73)..(85): a, c, t, g, unknown or other
  modified_base (102)..(110): a, c, t, g, unknown or other

SEQ ID NO: 1382 - DNA, 118 bp, Homo sapiens; identical to SEQ ID NO: 1380
  modified_base (13)..(24): a, c, t, g, unknown or other
  modified_base (69)..(81): a, c, t, g, unknown or other
  modified_base (98)..(106): a, c, t, g, unknown or other

SEQ ID NO: 1383 - DNA, 134 bp, Homo sapiens; identical to SEQ ID NO: 90
  modified_base (13)..(24): a, c, t, g, unknown or other
  modified_base (85)..(97): a, c, t, g, unknown or other
  modified_base (114)..(122): a, c, t, g, unknown or other

SEQ ID NO: 1384 - DNA, 130 bp, Homo sapiens
  modified_base (13)..(24): a, c, t, g, unknown or other
  modified_base (81)..(93): a, c, t, g, unknown or other
  modified_base (110)..(118): a, c, t, g, unknown or other
gatagatagatannnnnnnnnnnngatagatagatagatagatagatagatagatagatagatagatagatagatagatannnnnnnnnnnnnggatggatggatggatnnnnnnnnngatagatagata

SEQ ID NO: 1385 - DNA, 118 bp, Homo sapiens; identical to SEQ ID NO: 1380
  modified_base (13)..(24): a, c, t, g, unknown or other
  modified_base (69)..(81): a, c, t, g, unknown or other
  modified_base (98)..(106): a, c, t, g, unknown or other

SEQ ID NO: 1386 - DNA, 114 bp, Homo sapiens
  modified_base (13)..(24): a, c, t, g, unknown or other
  modified_base (65)..(77): a, c, t, g, unknown or other
  modified_base (94)..(102): a, c, t, g, unknown or other
gatagatagatannnnnnnnnnnngatagatagatagatagatagatagatagatagatagatannnnnnnnnnnnnggatggatggatggatnnnnnnnnngatagatagata

SEQ ID NO: 1387 - DNA, 130 bp, Homo sapiens; identical to SEQ ID NO: 1384
  modified_base (13)..(24): a, c, t, g, unknown or other
  modified_base (81)..(93): a, c, t, g, unknown or other
  modified_base (110)..(118): a, c, t, g, unknown or other

SEQ ID NO: 1388 - DNA, 134 bp, Homo sapiens; identical to SEQ ID NO: 90
  modified_base (13)..(24): a, c, t, g, unknown or other
  modified_base (85)..(97): a, c, t, g, unknown or other
  modified_base (114)..(122): a, c, t, g, unknown or other

SEQ ID NO: 1389 - DNA, 122 bp, Homo sapiens; identical to SEQ ID NO: 1377
  modified_base (13)..(24): a, c, t, g, unknown or other
  modified_base (73)..(85): a, c, t, g, unknown or other
  modified_base (102)..(110): a, c, t, g, unknown or other

SEQ ID NO: 1390 - DNA, 118 bp, Homo sapiens; identical to SEQ ID NO: 1380
  modified_base (13)..(24): a, c, t, g, unknown or other
  modified_base (69)..(81): a, c, t, g, unknown or other
  modified_base (98)..(106): a, c, t, g, unknown or other

SEQ ID NO: 1391 - DNA, 126 bp, Homo sapiens; identical to SEQ ID NO: 1378
  modified_base (13)..(24): a, c, t, g, unknown or other
  modified_base (77)..(89): a, c, t, g, unknown or other
  modified_base (106)..(114): a, c, t, g, unknown or other

SEQ ID NO: 1392 - DNA, 122 bp, Homo sapiens; identical to SEQ ID NO: 1377
  modified_base (13)..(24): a, c, t, g, unknown or other
  modified_base (73)..(85): a, c, t, g, unknown or other
  modified_base (102)..(110): a, c, t, g, unknown or other

SEQ ID NO: 1393 - DNA, 130 bp, Homo sapiens; identical to SEQ ID NO: 1384
  modified_base (13)..(24): a, c, t, g, unknown or other
  modified_base (81)..(93): a, c, t, g, unknown or other
  modified_base (110)..(118): a, c, t, g, unknown or other

SEQ ID NO: 1394 - DNA, 134 bp, Homo sapiens; identical to SEQ ID NO: 90
  modified_base (13)..(24): a, c, t, g, unknown or other
  modified_base (85)..(97): a, c, t, g, unknown or other
  modified_base (114)..(122): a, c, t, g, unknown or other

SEQ ID NO: 1395 - DNA, 122 bp, Homo sapiens; identical to SEQ ID NO: 1377
  modified_base (13)..(24): a, c, t, g, unknown or other
  modified_base (73)..(85): a, c, t, g, unknown or other
  modified_base (102)..(110): a, c, t, g, unknown or other

SEQ ID NO: 1396 - DNA, 126 bp, Homo sapiens; identical to SEQ ID NO: 1378
  modified_base (13)..(24): a, c, t, g, unknown or other
  modified_base (77)..(89): a, c, t, g, unknown or other
  modified_base (106)..(114): a, c, t, g, unknown or other

SEQ ID NO: 1397 - DNA, 52 bp, Homo sapiens; identical to SEQ ID NO: 110

SEQ ID NO: 1398 - DNA, 48 bp, Homo sapiens
gatagatagatagatagatagatagatagatagatagatagatagata

SEQ ID NO: 1399 - DNA, 44 bp, Homo sapiens
gatagatagatagatagatagatagatagatagatagatagata

SEQ ID NO: 1400 - DNA, 48 bp, Homo sapiens; identical to SEQ ID NO: 1398

SEQ ID NO: 1401 - DNA, 84 bp, Homo sapiens
tctatctatctatctatccatatctatctatccgtatctatctatctatctatctatctatctatctatctatctatctatcta

SEQ ID NO: 1402 - DNA, 88 bp, Homo sapiens
tctatctatctatctatccatatctatctatccgtatctatctatctatctatctatctatctatctatctatctatctatctatcta

SEQ ID NO: 1403 - DNA, 92 bp, Homo sapiens
tctatctatctatctatccatatctatctatccgtatctatctatctatctatctatctatctatctatctatctatctatctatctatcta

SEQ ID NO: 1404 - DNA, 88 bp, Homo sapiens; identical to SEQ ID NO: 1402

SEQ ID NO: 1405 - DNA, 88 bp, Homo sapiens; identical to SEQ ID NO: 1402

SEQ ID NO: 1406 - DNA, 84 bp, Homo sapiens; identical to SEQ ID NO: 1401

SEQ ID NO: 1407 - DNA, 88 bp, Homo sapiens; identical to SEQ ID NO: 1402

SEQ ID NO: 1408 - DNA, 92 bp, Homo sapiens; identical to SEQ ID NO: 1403

SEQ ID NO: 1409 - DNA, 88 bp, Homo sapiens; identical to SEQ ID NO: 1402

SEQ ID NO: 1410 - DNA, 92 bp, Homo sapiens; identical to SEQ ID NO: 1403

SEQ ID NO: 1411 - DNA, 88 bp, Homo sapiens; identical to SEQ ID NO: 1402

SEQ ID NO: 1412 - DNA, 92 bp, Homo sapiens; identical to SEQ ID NO: 1403

SEQ ID NO: 1413 - DNA, 84 bp, Homo sapiens; identical to SEQ ID NO: 1401

SEQ ID NO: 1414 - DNA, 80 bp, Homo sapiens
tctatctatctatctatccatatctatctatccgtatctatctatctatctatctatctatctatctatctatctatcta

SEQ ID NO: 1415 - DNA, 84 bp, Homo sapiens; identical to SEQ ID NO: 1401

SEQ ID NO: 1416 - DNA, 88 bp, Homo sapiens; identical to SEQ ID NO: 1402

SEQ ID NO: 1417 - DNA, 88 bp, Homo sapiens; identical to SEQ ID NO: 1402

SEQ ID NO: 1418 - DNA, 84 bp, Homo sapiens; identical to SEQ ID NO: 1401

SEQ ID NO: 1419 - DNA, 80 bp, Homo sapiens; identical to SEQ ID NO: 1414

SEQ ID NO: 1420 - DNA, 84 bp, Homo sapiens; identical to SEQ ID NO: 1401

SEQ ID NO: 1421 - DNA, 110 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttctttctttctttctttctttct

SEQ ID NO: 1422 - DNA, 106 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttctttctttctttctttct

SEQ ID NO: 1423 - DNA, 102 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttctttctttctttct

SEQ ID NO: 1424 - DNA, 98 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttctttctttct

SEQ ID NO: 1425 - DNA, 94 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttctttct

SEQ ID NO: 1426 - DNA, 98 bp, Homo sapiens; identical to SEQ ID NO: 1424
  modified_base (17)..(46): a, c, t, g, unknown or other

SEQ ID NO: 1427 - DNA, 106 bp, Homo sapiens; identical to SEQ ID NO: 1422
  modified_base (17)..(46): a, c, t, g, unknown or other

SEQ ID NO: 1428 - DNA, 110 bp, Homo sapiens; identical to SEQ ID NO: 1421
  modified_base (17)..(46): a, c, t, g, unknown or other

SEQ ID NO: 1429 - DNA, 98 bp, Homo sapiens; identical to SEQ ID NO: 1424
  modified_base (17)..(46): a, c, t, g, unknown or other

SEQ ID NO: 1430 - DNA, 102 bp, Homo sapiens; identical to SEQ ID NO: 1423
  modified_base (17)..(46): a, c, t, g, unknown or other

SEQ ID NO: 1431 - DNA, 94 bp, Homo sapiens; identical to SEQ ID NO: 1425
  modified_base (17)..(46): a, c, t, g, unknown or other

SEQ ID NO: 1432 - DNA, 98 bp, Homo sapiens; identical to SEQ ID NO: 1424
  modified_base (17)..(46): a, c, t, g, unknown or other

SEQ ID NO: 1433 - DNA, 102 bp, Homo sapiens; identical to SEQ ID NO: 1423
  modified_base (17)..(46): a, c, t, g, unknown or other

SEQ ID NO: 1434 - DNA, 106 bp, Homo sapiens; identical to SEQ ID NO: 1422
  modified_base (17)..(46): a, c, t, g, unknown or other

SEQ ID NO: 1435 - DNA, 106 bp, Homo sapiens; identical to SEQ ID NO: 1422
  modified_base (17)..(46): a, c, t, g, unknown or other

SEQ ID NO: 1436 - DNA, 110 bp, Homo sapiens; identical to SEQ ID NO: 1421
  modified_base (17)..(46): a, c, t, g, unknown or other

SEQ ID NO: 1437 - DNA, 106 bp, Homo sapiens; identical to SEQ ID NO: 1422
  modified_base (17)..(46): a, c, t, g, unknown or other

SEQ ID NO: 1438 - DNA, 110 bp, Homo sapiens; identical to SEQ ID NO: 1421
  modified_base (17)..(46): a, c, t, g, unknown or other

SEQ ID NO: 1439 - DNA, 94 bp, Homo sapiens; identical to SEQ ID NO: 1425
  modified_base (17)..(46): a, c, t, g, unknown or other

SEQ ID NO: 1440 - DNA, 90 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttct

SEQ ID NO: 1441 - DNA, 114 bp, Homo sapiens
  modified_base (17)..(46): a, c, t, g, unknown or other
ttctttctttctttctnnnnnnnnnnnnnnnnnnnnnnnnnnnnnnttctttctttctttctttctttctttctttctttctttctttctttctttctttctttctttctttct

SEQ ID NO: 1442 - DNA, 106 bp, Homo sapiens; identical to SEQ ID NO: 1422
  modified_base (17)..(46): a, c, t, g, unknown or other

SEQ ID NO: 1443 - DNA, 84 bp, Homo sapiens
  modified_base (65)..(72): a, c, t, g, unknown or other
aaagaaagaaagaaagaaagaaagaaagaaagaaagaaagaaagaaagaaagaaagaaagaaagnnnnnnnnaaagaaagaaag

SEQ ID NO: 1444 - DNA, 80 bp, Homo sapiens
  modified_base (61)..(68): a, c, t, g, unknown or other
aaagaaagaaagaaagaaagaaagaaagaaagaaagaaagaaagaaagaaagaaagaaagnnnnnnnnaaagaaagaaag

SEQ ID NO: 1445 - DNA, 76 bp, Homo sapiens
  modified_base (57)..(64): a, c, t, g, unknown or other
aaagaaagaaagaaagaaagaaagaaagaaagaaagaaagaaagaaagaaagaaagnnnnnnnnaaagaaagaaag

SEQ ID NO: 1446 - DNA, 80 bp, Homo sapiens; identical to SEQ ID NO: 1444
  modified_base (61)..(68): a, c, t, g, unknown or other

SEQ ID NO: 1447 - DNA, 84 bp, Homo sapiens; identical to SEQ ID NO: 1443
  modified_base (65)..(72): a, c, t, g, unknown or other

SEQ ID NO: 1448 - DNA, 80 bp, Homo sapiens; identical to SEQ ID NO: 1444
  modified_base (61)..(68): a, c, t, g, unknown or other

SEQ ID NO: 1449 - DNA, 76 bp, Homo sapiens; identical to SEQ ID NO: 1445
  modified_base (57)..(64): a, c, t, g, unknown or other

SEQ ID NO: 1450 - DNA, 80 bp, Homo sapiens; identical to SEQ ID NO: 1444
  modified_base (61)..(68): a, c, t, g, unknown or other

SEQ ID NO: 1451 - DNA, 76 bp, Homo sapiens; identical to SEQ ID NO: 1445
  modified_base (57)..(64): a, c, t, g, unknown or other

SEQ ID NO: 1452 - DNA, 80 bp, Homo sapiens; identical to SEQ ID NO: 1444
  modified_base (61)..(68): a, c, t, g, unknown or other

SEQ ID NO: 1453 - DNA, 217 bp, Homo sapiens
  modified_base (101)..(106): a, c, t, g, unknown or other
  modified_base (175)..(201): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1454 - DNA, 213 bp, Homo sapiens
  modified_base (97)..(102): a, c, t, g, unknown or other
  modified_base (171)..(197): a, c, t, g, unknown or other
aaagaaagaaaggaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1455 - DNA, 197 bp, Homo sapiens
  modified_base (93)..(98): a, c, t, g, unknown or other
  modified_base (155)..(181): a, c, t, g, unknown or other
aaagaaagaaaggaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1456 - DNA, 201 bp, Homo sapiens
  modified_base (93)..(98): a, c, t, g, unknown or other
  modified_base (159)..(185): a, c, t, g, unknown or other
aaagaaagaaaggaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1457 - DNA, 201 bp, Homo sapiens
  modified_base (105)..(110): a, c, t, g, unknown or other
  modified_base (159)..(185): a, c, t, g, unknown or other
aaagaaagaaaggaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagnnnnnnnnnnnnnnnnnnnnnnnnnnnaaggaaggaaggaagg

SEQ ID NO: 1458 - DNA, 197 bp, Homo sapiens
  modified_base (101)..(106): a, c, t, g, unknown or other
  modified_base (155)..(181): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagnnnnnnnnnnnnnnnnnnnnnnnnnnnaaggaaggaaggaagg

SEQ ID NO: 1459 - DNA, 205 bp, Homo sapiens
  modified_base (97)..(102): a, c, t, g, unknown or other
  modified_base (163)..(189): a, c, t, g, unknown or other
aaagaaagaaaggaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1460 - DNA, 201 bp, Homo sapiens; identical to SEQ ID NO: 1456
  modified_base (93)..(98): a, c, t, g, unknown or other
  modified_base (159)..(185): a, c, t, g, unknown or other

SEQ ID NO: 1461 - DNA, 221 bp, Homo sapiens
  modified_base (109)..(114): a, c, t, g, unknown or other
  modified_base (179)..(205): a, c, t, g, unknown or other
aaagaaagaaaggaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1462 - DNA, 217 bp, Homo sapiens
  modified_base (105)..(110): a, c, t, g, unknown or other
  modified_base (175)..(201): a, c, t, g, unknown or other
aaagaaagaaaggaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1463 - DNA, 205 bp, Homo sapiens
  modified_base (105)..(110): a, c, t, g, unknown or other
  modified_base (163)..(189): a, c, t, g, unknown or other
aaagaaagaaaggaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1464 - DNA, 201 bp, Homo sapiens
  modified_base (101)..(106): a, c, t, g, unknown or other
  modified_base (159)..(185): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1465 - DNA, 229 bp, Homo sapiens
  modified_base (113)..(118): a, c, t, g, unknown or other
  modified_base (187)..(213): a, c, t, g, unknown or other
aaagaaagaaaggaagaaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1466 - DNA, 225 bp, Homo sapiens
  modified_base (109)..(114): a, c, t, g, unknown or other
  modified_base (183)..(209): a, c, t, g, unknown or other
aaagaaagaaaggaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1467 - DNA, 217 bp, Homo sapiens
  modified_base (109)..(114): a, c, t, g, unknown or other
  modified_base (175)..(201): a, c, t, g, unknown or other
aaagaaagaaaggaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1468 - DNA, 221 bp, Homo sapiens
  modified_base (113)..(118): a, c, t, g, unknown or other
  modified_base (179)..(205): a, c, t, g, unknown or other
aaagaaagaaaggaagaaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1469 - DNA, 225 bp, Homo sapiens
  modified_base (125)..(130): a, c, t, g, unknown or other
  modified_base (183)..(209): a, c, t, g, unknown or other
aaagaaagaaaggaagaaagaaagaaagaaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1470 - DNA, 221 bp, Homo sapiens
  modified_base (121)..(126): a, c, t, g, unknown or other
  modified_base (179)..(205): a, c, t, g, unknown or other
aaagaaagaaaggaagaaagaaagaaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1471 - DNA, 193 bp, Homo sapiens
  modified_base (97)..(102): a, c, t, g, unknown or other
  modified_base (151)..(177): a, c, t, g, unknown or other
aaagaaagaaaggaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagnnnnnnnnnnnnnnnnnnnnnnnnnnnaaggaaggaaggaagg

SEQ ID NO: 1472 - DNA, 189 bp, Homo sapiens
  modified_base (97)..(102): a, c, t, g, unknown or other
  modified_base (147)..(173): a, c, t, g, unknown or other
aaagaaagaaaggaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagnnnnnnnnnnnnnnnnnnnnnnnnnnnaaggaaggaaggaagg

SEQ ID NO: 1473 - DNA, 213 bp, Homo sapiens; identical to SEQ ID NO: 1454
  modified_base (97)..(102): a, c, t, g, unknown or other
  modified_base (171)..(197): a, c, t, g, unknown or other

SEQ ID NO: 1474 - DNA, 209 bp, Homo sapiens
  modified_base (97)..(102): a, c, t, g, unknown or other
  modified_base (167)..(193): a, c, t, g, unknown or other
aaagaaagaaaggaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1475 - DNA, 213 bp, Homo sapiens
  modified_base (109)..(114): a, c, t, g, unknown or other
  modified_base (171)..(197): a, c, t, g, unknown or other
aaagaaagaaaggaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1476 - DNA, 209 bp, Homo sapiens
  modified_base (105)..(110): a, c, t, g, unknown or other
  modified_base (167)..(193): a, c, t, g, unknown or other
aaagaaagaaaggaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1477 - DNA, 153 bp, Homo sapiens
  modified_base (101)..(106): a, c, t, g, unknown or other
  modified_base (111)..(137): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagnnnnnnnnnnnnnnnnnnnnnnnnnnnaaggaaggaaggaagg

SEQ ID NO: 1478 - DNA, 213 bp, Homo sapiens; identical to SEQ ID NO: 1454
  modified_base (97)..(102): a, c, t, g, unknown or other
  modified_base (171)..(197): a, c, t, g, unknown or other

SEQ ID NO: 1479 - DNA, 205 bp, Homo sapiens
  modified_base (101)..(106): a, c, t, g, unknown or other
  modified_base (163)..(189): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1480 - DNA, 209 bp, Homo sapiens
  modified_base (101)..(106): a, c, t, g, unknown or other
  modified_base (167)..(193): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1481 - DNA, 213 bp, Homo sapiens
  modified_base (105)..(110): a, c, t, g, unknown or other
  modified_base (171)..(197): a, c, t, g, unknown or other
aaagaaagaaaggaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1482 - DNA, 209 bp, Homo sapiens; identical to SEQ ID NO: 1480
  modified_base (101)..(106): a, c, t, g, unknown or other
  modified_base (167)..(193): a, c, t, g, unknown or other

SEQ ID NO: 1483 - DNA, 209 bp, Homo sapiens; identical to SEQ ID NO: 1474
  modified_base (97)..(102): a, c, t, g, unknown or other
  modified_base (167)..(193): a, c, t, g, unknown or other

SEQ ID NO: 1484 - DNA, 213 bp, Homo sapiens; identical to SEQ ID NO: 1454
  modified_base (97)..(102): a, c, t, g, unknown or other
  modified_base (171)..(197): a, c, t, g, unknown or other

SEQ ID NO: 1485 - DNA, 209 bp, Homo sapiens; identical to SEQ ID NO: 1474
  modified_base (97)..(102): a, c, t, g, unknown or other
  modified_base (167)..(193): a, c, t, g, unknown or other

SEQ ID NO: 1486 - DNA, 213 bp, Homo sapiens
  modified_base (101)..(106): a, c, t, g, unknown or other
  modified_base (171)..(197): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1487 - DNA, 209 bp, Homo sapiens; identical to SEQ ID NO: 1476
  modified_base (105)..(110): a, c, t, g, unknown or other
  modified_base (167)..(193): a, c, t, g, unknown or other

SEQ ID NO: 1488 - DNA, 213 bp, Homo sapiens; identical to SEQ ID NO: 1486
  modified_base (101)..(106): a, c, t, g, unknown or other
  modified_base (171)..(197): a, c, t, g, unknown or other

SEQ ID NO: 1489 - DNA, 221 bp, Homo sapiens
  modified_base (101)..(106): a, c, t, g, unknown or other
  modified_base (179)..(205): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1490 - DNA, 217 bp, Homo sapiens; identical to SEQ ID NO: 1453
  modified_base (101)..(106): a, c, t, g, unknown or other
  modified_base (175)..(201): a, c, t, g, unknown or other

SEQ ID NO: 1491 - DNA, 209 bp, Homo sapiens; identical to SEQ ID NO: 1474
  modified_base (97)..(102): a, c, t, g, unknown or other
  modified_base (167)..(193): a, c, t, g, unknown or other

SEQ ID NO: 1492 - DNA, 205 bp, Homo sapiens
  modified_base (93)..(98): a, c, t, g, unknown or other
  modified_base (163)..(189): a, c, t, g, unknown or other
aaagaaagaaaggaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1493 - DNA, 217 bp, Homo sapiens; identical to SEQ ID NO: 1462
  modified_base (105)..(110): a, c, t, g, unknown or other
  modified_base (175)..(201): a, c, t, g, unknown or other

SEQ ID NO: 1494 - DNA, 213 bp, Homo sapiens; identical to SEQ ID NO: 1481
  modified_base (105)..(110): a, c, t, g, unknown or other
  modified_base (171)..(197): a, c, t, g, unknown or other

SEQ ID NO: 1495 - DNA, 221 bp, Homo sapiens
  modified_base (105)..(110): a, c, t, g, unknown or other
  modified_base (179)..(205): a, c, t, g, unknown or other
aaagaaagaaaggaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1496 - DNA, 217 bp, Homo sapiens; identical to SEQ ID NO: 1462
  modified_base (105)..(110): a, c, t, g, unknown or other
  modified_base (175)..(201): a, c, t, g, unknown or other

SEQ ID NO: 1497 - DNA, 225 bp, Homo sapiens; identical to SEQ ID NO: 1466
  modified_base (109)..(114): a, c, t, g, unknown or other
  modified_base (183)..(209): a, c, t, g, unknown or other

SEQ ID NO: 1498 - DNA, 229 bp, Homo sapiens
  modified_base (109)..(114): a, c, t, g, unknown or other
  modified_base (187)..(213): a, c, t, g, unknown or other
aaagaaagaaaggaagaaagaaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1499 - DNA, 221 bp, Homo sapiens; identical to SEQ ID NO: 1495
  modified_base (105)..(110): a, c, t, g, unknown or other
  modified_base (179)..(205): a, c, t, g, unknown or other

SEQ ID NO: 1500 - DNA, 217 bp, Homo sapiens; identical to SEQ ID NO: 1462
  modified_base (105)..(110): a, c, t, g, unknown or other
  modified_base (175)..(201): a, c, t, g, unknown or other

SEQ ID NO: 1501 - DNA, 197 bp, Homo sapiens
  modified_base (97)..(102): a, c, t, g, unknown or other
  modified_base (155)..(181): a, c, t, g, unknown or other
aaagaaagaaaggaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1502 - DNA, 201 bp, Homo sapiens; identical to SEQ ID NO: 1464
  modified_base (101)..(106): a, c, t, g, unknown or other
  modified_base (159)..(185): a, c, t, g, unknown or other

SEQ ID NO: 1503 - DNA, 217 bp, Homo sapiens; identical to SEQ ID NO: 1453
  modified_base (101)..(106): a, c, t, g, unknown or other
  modified_base (175)..(201): a, c, t, g, unknown or other

SEQ ID NO: 1504 - DNA, 205 bp, Homo sapiens; identical to SEQ ID NO: 1459
  modified_base (97)..(102): a, c, t, g, unknown or other
  modified_base (163)..(189): a, c, t, g, unknown or other

SEQ ID NO: 1505 - DNA, 221 bp, Homo sapiens; identical to SEQ ID NO: 1489
  modified_base (101)..(106): a, c, t, g, unknown or other
  modified_base (179)..(205): a, c, t, g, unknown or other

SEQ ID NO: 1506 - DNA, 225 bp, Homo sapiens
  modified_base (101)..(106): a, c, t, g, unknown or other
  modified_base (183)..(209): a, c, t, g, unknown or other
aaagaaagaaaggaagaaagaaagaaagaaagaaagaaagaaagaaagaaagaaagaaagaaagaaagaaagaaagaaagggagaaagaaagaaagaaagnnnnnnaaagaaagaaagaaagaaagaaagaaagaaagaaagaaagaaagaaagaaagaaagaaagaaagaaagaaagaaagnnnnnnnnnnnnnnnnnnnnnnnnnnnaaggaaggaaggaagg

SEQ ID NO: 1507 - DNA, 209 bp, Homo sapiens; identical to SEQ ID NO: 1480
  modified_base (101)..(106): a, c, t, g, unknown or other
  modified_base (167)..(193): a, c, t, g, unknown or other

SEQ ID NO: 1508 - DNA, 205 bp, Homo sapiens; identical to SEQ ID NO: 1459
  modified_base (97)..(102): a, c, t, g, unknown or other
  modified_base (163)..(189): a, c, t, g, unknown or other

SEQ ID NO: 1509 - DNA, 92 bp, Homo sapiens
gatagatagatagatagatagatagatagatagatagatagatagatacatacatacatacatacatacatacatacatacatacatacata

SEQ ID NO: 1510 - DNA, 88 bp, Homo sapiens
gatagatagatagatagatagatagatagatagatagatagatacatacatacatacatacatacatacatacatacatacatacata

SEQ ID NO: 1511 - DNA, 92 bp, Homo sapiens; identical to SEQ ID NO: 1509

SEQ ID NO: 1512 - DNA, 88 bp, Homo sapiens; identical to SEQ ID NO: 1510

SEQ ID NO: 1513 - DNA, 88 bp, Homo sapiens
gatagatagatagatagatagatagatagatagatagatagatagatacatacatacatacatacatacatacatacatacatacata

SEQ ID NO: 1514 - DNA, 92 bp, Homo sapiens; identical to SEQ ID NO: 1509

SEQ ID NO: 1515 - DNA, 88 bp, Homo sapiens; identical to SEQ ID NO: 1510

SEQ ID NO: 1516 - DNA, 92 bp, Homo sapiens; identical to SEQ ID NO: 1509

SEQ ID NO: 1517 - DNA, 109 bp, Homo sapiens
ctttctttctttctttcttttctttctttcttttttctttctttctttctttcttttctttctttctttctttctttctttctttctttctttctttctttctttcttt

SEQ ID NO: 1518 - DNA, 105 bp, Homo sapiens
ctttctttctttctttcttttctttctttcttttttctttctttctttctttcttttctttctttctttctttctttctttctttctttctttctttctttcttt

SEQ ID NO: 1519 - DNA, 40 bp, Homo sapiens
atagatagatagatagatagatagatagatagatagatag

SEQ ID NO: 1520 - DNA, 44 bp, Homo sapiens
atagatagatagatagatagatagatagatagatagatagatag

SEQ ID NO: 1521 - DNA, 44 bp, Homo sapiens
agatagatagatagatagatagatagatagatagatagatagat

SEQ ID NO: 1522 - DNA, 40 bp, Homo sapiens
agatagatagatagatagatagatagatagatagatagat

SEQ ID NO: 1523 - DNA, 64 bp, Homo sapiens
ccttccttccttccttccttccttccttccttccttccttccttccttccttccttccttcctt

SEQ ID NO: 1524 - DNA, 60 bp, Homo sapiens
ccttccttccttccttccttccttccttccttccttccttccttccttccttccttcctt

SEQ ID NO: 1525 - DNA, 52 bp, Homo sapiens
ccttccttccttccttccttccttccttccttccttccttccttccttcctt

SEQ ID NO: 1526 - DNA, 56 bp, Homo sapiens
ccttccttccttccttccttccttccttccttccttccttccttccttccttcctt

SEQ ID NO: 1527 - DNA, 56 bp, Homo sapiens; identical to SEQ ID NO: 1526

SEQ ID NO: 1528 - DNA, 52 bp, Homo sapiens; identical to SEQ ID NO: 1525

SEQ ID NO: 1529 - DNA, 44 bp, Homo sapiens
ccttccttccttccttccttccttccttccttccttccttcctt

SEQ ID NO: 1530 - DNA, 48 bp, Homo sapiens
ccttccttccttccttccttccttccttccttccttccttccttcctt

SEQ ID NO: 1531 - DNA, 281 bp, Homo sapiens
  modified_base (13)..(32): a, c, t, g, unknown or other
  modified_base (125)..(237): a, c, t, g, unknown or other
ccctccctccctnnnnnnnnnnnnnnnnnnnnctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttcctt

SEQ ID NO: 1532 - DNA, 277 bp, Homo sapiens
  modified_base (13)..(32): a, c, t, g, unknown or other
  modified_base (121)..(233): a, c, t, g, unknown or other
ccctccctccctnnnnnnnnnnnnnnnnnnnnctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttcctt

SEQ ID NO: 1533 - DNA, 301 bp, Homo sapiens
  modified_base (13)..(32): a, c, t, g, unknown or other
  modified_base (133)..(245): a, c, t, g, unknown or other
ccctccctccctnnnnnnnnnnnnnnnnnnnnctttctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1534 - DNA, 297 bp, Homo sapiens
  modified_base (13)..(32): a, c, t, g, unknown or other
  modified_base (129)..(241): a, c, t, g, unknown or other
ccctccctccctnnnnnnnnnnnnnnnnnnnnctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1535 - DNA, 305 bp, Homo sapiens
  modified_base (13)..(32): a, c, t, g, unknown or other
  modified_base (137)..(249): a, c, t, g, unknown or other
ccctccctccctnnnnnnnnnnnnnnnnnnnnctttctttctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1536 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1537 - DNA, 293 bp, Homo sapiens
  modified_base (13)..(32): a, c, t, g, unknown or other
  modified_base (133)..(245): a, c, t, g, unknown or other
ccctccctccctnnnnnnnnnnnnnnnnnnnnctttctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttcctt

SEQ ID NO: 1538 - DNA, 289 bp, Homo sapiens
  modified_base (13)..(32): a, c, t, g, unknown or other
  modified_base (129)..(241): a, c, t, g, unknown or other
ccctccctccctnnnnnnnnnnnnnnnnnnnnctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttcctt

SEQ ID NO: 1539 - DNA, 305 bp, Homo sapiens; identical to SEQ ID NO: 1535
  modified_base (13)..(32): a, c, t, g, unknown or other
  modified_base (137)..(249): a, c, t, g, unknown or other

SEQ ID NO: 1540 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1541 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1542 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1543 - DNA, 281 bp, Homo sapiens
  modified_base (13)..(32): a, c, t, g, unknown or other
  modified_base (113)..(225): a, c, t, g, unknown or other
ccctccctccctnnnnnnnnnnnnnnnnnnnnctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1544 - DNA, 285 bp, Homo sapiens
  modified_base (13)..(32): a, c, t, g, unknown or other
  modified_base (117)..(229): a, c, t, g, unknown or other
ccctccctccctnnnnnnnnnnnnnnnnnnnnctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1545 - DNA, 285 bp, Homo sapiens
  modified_base (13)..(32): a, c, t, g, unknown or other
  modified_base (133)..(245): a, c, t, g, unknown or other
ccctccctccctnnnnnnnnnnnnnnnnnnnnctttctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttcctt

SEQ ID NO: 1546 - DNA, 289 bp, Homo sapiens
  modified_base (13)..(32): a, c, t, g, unknown or other
  modified_base (137)..(249): a, c, t, g, unknown or other
ccctccctccctnnnnnnnnnnnnnnnnnnnnctttctttctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttcctt

SEQ ID NO: 1547 - DNA, 289 bp, Homo sapiens; identical to SEQ ID NO: 1546
  modified_base (13)..(32): a, c, t, g, unknown or other
  modified_base (137)..(249): a, c, t, g, unknown or other

SEQ ID NO: 1548 - DNA, 285 bp, Homo sapiens; identical to SEQ ID NO: 1545
  modified_base (13)..(32): a, c, t, g, unknown or other
  modified_base (133)..(245): a, c, t, g, unknown or other

SEQ ID NO: 1549 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1550 - DNA, 305 bp, Homo sapiens; identical to SEQ ID NO: 1535
  modified_base (13)..(32): a, c, t, g, unknown or other
  modified_base (137)..(249): a, c, t, g, unknown or other

SEQ ID NO: 1551 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1552 - DNA, 293 bp, Homo sapiens
  modified_base (13)..(32): a, c, t, g, unknown or other
  modified_base (125)..(237): a, c, t, g, unknown or other
ccctccctccctnnnnnnnnnnnnnnnnnnnnctttctttctttctttctttctttctttctttctttctttctttctttctttctttctttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1553 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1554 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1555 - DNA, 293 bp, Homo sapiens
  modified_base (13)..(32): a, c, t, g, unknown or other
  modified_base (125)..(237): a, c, t, g, unknown or other
ccctccctccctnnnnnnnnnnnnnnnnnnnnctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1556 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1557 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1558 - DNA, 293 bp, Homo sapiens; identical to SEQ ID NO: 1555
  modified_base (13)..(32): a, c, t, g, unknown or other
  modified_base (125)..(237): a, c, t, g, unknown or other

SEQ ID NO: 1559 - DNA, 289 bp, Homo sapiens
  modified_base (13)..(32): a, c, t, g, unknown or other
  modified_base (121)..(233): a, c, t, g, unknown or other
ccctccctccctnnnnnnnnnnnnnnnnnnnnctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttccttcctt

SEQ ID NO: 1560 - DNA, 293 bp, Homo sapiens; identical to SEQ ID NO: 1555
  modified_base (13)..(32): a, c, t, g, unknown or other
  modified_base (125)..(237): a, c, t, g, unknown or other

SEQ ID NO: 1561 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1562 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1563 - DNA, 281 bp, Homo sapiens
  modified_base (13)..(32): a, c, t, g, unknown or other
  modified_base (121)..(233): a, c, t, g, unknown or other
ccctccctccctnnnnnnnnnnnnnnnnnnnnctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttcctt

SEQ ID NO: 1564 - DNA, 285 bp, Homo sapiens
  modified_base (13)..(32): a, c, t, g, unknown or other
  modified_base (125)..(237): a, c, t, g, unknown or other
ccctccctccctnnnnnnnnnnnnnnnnnnnnctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttcctt

SEQ ID NO: 1565 - DNA, 285 bp, Homo sapiens
  modified_base (13)..(32): a, c, t, g, unknown or other
  modified_base (121)..(233): a, c, t, g, unknown or other
ccctccctccctnnnnnnnnnnnnnnnnnnnnctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttcctt

SEQ ID NO: 1566 - DNA, 281 bp, Homo sapiens
  modified_base (13)..(32): a, c, t, g, unknown or other
  modified_base (117)..(229): a, c, t, g, unknown or other
ccctccctccctnnnnnnnnnnnnnnnnnnnnctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttcctt

SEQ ID NO: 1567 - DNA, 289 bp, Homo sapiens
  modified_base (13)..(32): a, c, t, g, unknown or other
  modified_base (125)..(237): a, c, t, g, unknown or other
ccctccctccctnnnnnnnnnnnnnnnnnnnnctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttcctt

SEQ ID NO: 1568 - DNA, 293 bp, Homo sapiens
  modified_base (13)..(32): a, c, t, g, unknown or other
  modified_base (129)..(241): a, c, t, g, unknown or other
ccctccctccctnnnnnnnnnnnnnnnnnnnnctttctttctttctttctttctttctttctttctttctttctttctttctttctttctttccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccttccttccttccttccttccttccttccttccttccttccttcctt

SEQ ID NO: 1569 - DNA, 297 bp, Homo sapiens; identical to SEQ ID NO: 1534
  modified_base (13)..(32): a, c, t, g, unknown or other
  modified_base (129)..(241): a, c, t, g, unknown or other

SEQ ID NO: 1570 - DNA, 301 bp, Homo sapiens; identical to SEQ ID NO: 1533
  modified_base (13)..(32): a, c, t, g, unknown or other
  modified_base (133)..(245): a, c, t, g, unknown or other

SEQ ID NO: 1571 - DNA, 44 bp, Homo sapiens; identical to SEQ ID NO: 138

SEQ ID NO: 1572 - DNA, 36 bp, Homo sapiens; identical to SEQ ID NO: 954

SEQ ID NO: 1573 - DNA, 268 bp, Homo sapiens
  modified_base (13)..(17): a, c, t, g, unknown or other
  modified_base (38)..(46): a, c, t, g, unknown or other
  modified_base (111)..(127): a, c, t, g, unknown or other
  modified_base (140)..(152): a, c, t, g, unknown or other
  modified_base (169)..(238): a, c, t, g, unknown or other
  modified_base (251)..(256): a, c, t, g, unknown or other
tccctccctcccnnnnnttccttccttccttccttccnnnnnnnnnttctttctttctttccttctttctttctttctttctttctttctttctttctttctttctttctnnnnnnnnnnnnnnnnnttctttctttctnnnnnnnnnnnnnttccttccttccttccnnnnnnnnnnnnnnnnnnnnnnnnnnnnnnnnnnnnnnnnnnnnnnnnnnnnnnnnnnnnnnnnnnnnnnttctttctttctnnnnnnttctttctttct

SEQ ID NO: 1574 - DNA, 272 bp, Homo sapiens
  modified_base (13)..(17): a, c, t, g, unknown or other
  modified_base (38)..(46): a, c, t, g, unknown or other
  modified_base (115)..(131): a, c, t, g, unknown or other
  modified_base (144)..(156): a, c, t, g, unknown or other
  modified_base (173)..(242): a, c, t, g, unknown or other
  modified_base (255)..(260): a, c, t, g, unknown or other
tccctccctcccnnnnnttccttccttccttccttccnnnnnnnnnttctttctttctttccttctttctttctttctttctttctttctttctttctttctttctttctttctnnnnnnnnnnnnnnnnnttctttctttctnnnnnnnnnnnnnttccttccttccttccnnnnnnnnnnnnnnnnnnnnnnnnnnnnnnnnnnnnnnnnnnnnnnnnnnnnnnnnnnnnnnnnnnnnnnttctttctttctnnnnnnttctttctttct

SEQ ID NO: 1575 - DNA, 268 bp, Homo sapiens; identical to SEQ ID NO: 1573
  modified_base (13)..(17): a, c, t, g, unknown or other
  modified_base (38)..(46): a, c, t, g, unknown or other
  modified_base (111)..(127): a, c, t, g, unknown or other
  modified_base (140)..(152): a, c, t, g, unknown or other
  modified_base (169)..(238): a, c, t, g, unknown or other
  modified_base (251)..(256): a, c, t, g, unknown or other

SEQ ID NO: 1576 - DNA, 264 bp, Homo sapiens
  modified_base (13)..(17): a, c, t, g, unknown or other
  modified_base (38)..(46): a, c, t, g, unknown or other
  modified_base (107)..(123): a, c, t, g, unknown or other
  modified_base (136)..(148): a, c, t, g, unknown or other
  modified_base (165)..(234): a, c, t, g, unknown or other
  modified_base (247)..(252): a, c, t, g, unknown or other
tccctccctcccnnnnnttccttccttccttccttccnnnnnnnnnttctttctttctttccttctttctttctttctttctttctttctttctttctttctttctnnnnnnnnnnnnnnnnnttctttctttctnnnnnnnnnnnnnttccttccttccttccnnnnnnnnnnnnnnnnnnnnnnnnnnnnnnnnnnnnnnnnnnnnnnnnnnnnnnnnnnnnnnnnnnnnnnttctttctttctnnnnnnttctttctttct

SEQ ID NO: 1577 - DNA, 268 bp, Homo sapiens; identical to SEQ ID NO: 1573
  modified_base (13)..(17): a, c, t, g, unknown or other
  modified_base (38)..(46): a, c, t, g, unknown or other
  modified_base (111)..(127): a, c, t, g, unknown or other
  modified_base (140)..(152): a, c, t, g, unknown or other
  modified_base (169)..(238): a, c, t, g, unknown or other
  modified_base (251)..(256): a, c, t, g, unknown or other

SEQ ID NO: 1578 - DNA, 272 bp, Homo sapiens; identical to SEQ ID NO: 1574
  modified_base (13)..(17): a, c, t, g, unknown or other
  modified_base (38)..(46): a, c, t, g, unknown or other
  modified_base (115)..(131): a, c, t, g, unknown or other
  modified_base (144)..(156): a, c, t, g, unknown or other
  modified_base (173)..(242): a, c, t, g, unknown or other
  modified_base (255)..(260): a, c, t, g, unknown or other

SEQ ID NO: 1579 - DNA, 268 bp, Homo sapiens; identical to SEQ ID NO: 1573
  modified_base (13)..(17): a, c, t, g, unknown or other
  modified_base (38)..(46): a, c, t, g, unknown or other
  modified_base (111)..(127): a, c, t, g, unknown or other
  modified_base (140)..(152): a, c, t, g, unknown or other
  modified_base (169)..(238): a, c, t, g, unknown or other
  modified_base (251)..(256): a, c, t, g, unknown or other

SEQ ID NO: 1580 - DNA, 272 bp, Homo sapiens; identical to SEQ ID NO: 1574
  modified_base (13)..(17): a, c, t, g, unknown or other
  modified_base (38)..(46): a, c, t, g, unknown or other
  modified_base (115)..(131): a, c, t, g, unknown or other
  modified_base (144)..(156): a, c, t, g, unknown or other
  modified_base (173)..(242): a, c, t, g, unknown or other
  modified_base (255)..(260): a, c, t, g, unknown or other

SEQ ID NO: 1581 - DNA, 52 bp, Homo sapiens; identical to SEQ ID NO: 947

SEQ ID NO: 1582 - DNA, 48 bp, Homo sapiens; identical to SEQ ID NO: 171

SEQ ID NO: 1583 - DNA, 52 bp, Homo sapiens; identical to SEQ ID NO: 947

SEQ ID NO: 1584 - DNA, 48 bp, Homo sapiens; identical to SEQ ID NO: 171

SEQ ID NO: 1585 - DNA, 52 bp, Homo sapiens; identical to SEQ ID NO: 947

SEQ ID NO: 1586 - DNA, 48 bp, Homo sapiens; identical to SEQ ID NO: 171

SEQ ID NO: 1587 - DNA, 52 bp, Homo sapiens; identical to SEQ ID NO: 947

SEQ ID NO: 1588 - DNA, 56 bp, Homo sapiens; identical to SEQ ID NO: 18

SEQ ID NO: 1589 - DNA, 48 bp, Homo sapiens; identical to SEQ ID NO: 171

SEQ ID NO: 1590 - DNA, 52 bp, Homo sapiens; identical to SEQ ID NO: 947

SEQ ID NO: 1591 - DNA, 56 bp, Homo sapiens; identical to SEQ ID NO: 18

SEQ ID NO: 1592 - DNA, 60 bp, Homo sapiens; identical to SEQ ID NO: 88

SEQ ID NO: 1593 - DNA, 48 bp, Homo sapiens; identical to SEQ ID NO: 171

SEQ ID NO: 1594 - DNA, 52 bp, Homo sapiens; identical to SEQ ID NO: 947

SEQ ID NO: 1595 - DNA, 52 bp, Homo sapiens; identical to SEQ ID NO: 947

SEQ ID NO: 1596 - DNA, 48 bp, Homo sapiens; identical to SEQ ID NO: 171

SEQ ID NO: 1597 - DNA, 105 bp, Homo sapiens
  modified_base (13)..(20): a, c, t, g, unknown or other
  modified_base (85)..(93): a, c, t, g, unknown or other
ctttctttctttnnnnnnnnctttctttctttctttctttctttctttctttctttctttctttctttctttctttctttctttnnnnnnnnnctttctttcttt

SEQ ID NO: 1598 - DNA, 109 bp, Homo sapiens
  modified_base (13)..(20): a, c, t, g, unknown or other
  modified_base (89)..(97): a, c, t, g, unknown or other
ctttctttctttnnnnnnnnctttctttctttctttctttctttctttctttctttctttctttctttctttctttctttctttctttnnnnnnnnnctttctttcttt

SEQ ID NO: 1599 - DNA, 105 bp, Homo sapiens; identical to SEQ ID NO: 1597
  modified_base (13)..(20): a, c, t, g, unknown or other
  modified_base (85)..(93): a, c, t, g, unknown or other

SEQ ID NO: 1600 - DNA, 109 bp, Homo sapiens; identical to SEQ ID NO: 1598
  modified_base (13)..(20): a, c, t, g, unknown or other
  modified_base (89)..(97): a, c, t, g, unknown or other

SEQ ID NO: 1601 - DNA, 101 bp, Homo sapiens
  modified_base (13)..(20): a, c, t, g, unknown or other
  modified_base (81)..(89): a, c, t, g, unknown or other
ctttctttctttnnnnnnnnctttctttctttctttctttctttctttctttctttctttctttctttctttctttctttnnnnnnnnnctttctttcttt

SEQ ID NO: 1602 - DNA, 105 bp, Homo sapiens; identical to SEQ ID NO: 1597
  modified_base (13)..(20): a, c, t, g, unknown or other
  modified_base (85)..(93): a, c, t, g, unknown or other

SEQ ID NO: 1603 - DNA, 97 bp, Homo sapiens
  modified_base (13)..(20): a, c, t, g, unknown or other
  modified_base (77)..(85): a, c, t, g, unknown or other
ctttctttctttnnnnnnnnctttctttctttctttctttctttctttctttctttctttctttctttctttctttnnnnnnnnnctttctttcttt

SEQ ID NO: 1604 - DNA, 101 bp, Homo sapiens; identical to SEQ ID NO: 1601
  modified_base (13)..(20): a, c, t, g, unknown or other
  modified_base (81)..(89): a, c, t, g, unknown or other

SEQ ID NO: 1605 - DNA, 97 bp, Homo sapiens; identical to SEQ ID NO: 1603
  modified_base (13)..(20): a, c, t, g, unknown or other
  modified_base (77)..(85): a, c, t, g, unknown or other

SEQ ID NO: 1606 - DNA, 101 bp, Homo sapiens; identical to SEQ ID NO: 1601
  modified_base (13)..(20): a, c, t, g, unknown or other
  modified_base (81)..(89): a, c, t, g, unknown or other

SEQ ID NO: 1607 - DNA, 109 bp, Homo sapiens; identical to SEQ ID NO: 1598
  modified_base (13)..(20): a, c, t, g, unknown or other
  modified_base (89)..(97): a, c, t, g, unknown or other

SEQ ID NO: 1608 - DNA, 105 bp, Homo sapiens; identical to SEQ ID NO: 1597
  modified_base (13)..(20): a, c, t, g, unknown or other
  modified_base (85)..(93): a, c, t, g, unknown or other

SEQ ID NO: 1609 - DNA, 113 bp, Homo sapiens
  modified_base (13)..(20): a, c, t, g, unknown or other
  modified_base (93)..(101): a, c, t, g, unknown or other
ctttctttctttnnnnnnnnctttctttctttctttctttctttctttctttctttctttctttctttctttctttctttctttctttctttnnnnnnnnnctttctttcttt

SEQ ID NO: 1610 - DNA, 117 bp, Homo sapiens
  modified_base (13)..(20): a, c, t, g, unknown or other
  modified_base (97)..(105): a, c, t, g, unknown or other
ctttctttctttnnnnnnnnctttctttctttctttctttctttctttctttctttctttctttctttctttctttctttctttctttctttctttnnnnnnnnnctttctttcttt

SEQ ID NO: 1611 - DNA, 93 bp, Homo sapiens
  modified_base (13)..(20): a, c, t, g, unknown or other
  modified_base (73)..(81): a, c, t, g, unknown or other
ctttctttctttnnnnnnnnctttctttctttctttctttctttctttctttctttctttctttctttctttnnnnnnnnnctttctttcttt

SEQ ID NO: 1612 - DNA, 97 bp, Homo sapiens; identical to SEQ ID NO: 1603
  modified_base (13)..(20): a, c, t, g, unknown or other
  modified_base (77)..(85): a, c, t, g, unknown or other

SEQ ID NO: 1613 - DNA, 105 bp, Homo sapiens; identical to SEQ ID NO: 1597
  modified_base (13)..(20): a, c, t, g, unknown or other
  modified_base (85)..(93): a, c, t, g, unknown or other

SEQ ID NO: 1614 - DNA, 109 bp, Homo sapiens; identical to SEQ ID NO: 1598
  modified_base (13)..(20): a, c, t, g, unknown or other
  modified_base (89)..(97): a, c, t, g, unknown or other

SEQ ID NO: 1615 - DNA, 97 bp, Homo sapiens; identical to SEQ ID NO: 1603
  modified_base (13)..(20): a, c, t, g, unknown or other
  modified_base (77)..(85): a, c, t, g, unknown or other

SEQ ID NO: 1616 - DNA, 93 bp, Homo sapiens; identical to SEQ ID NO: 1611
  modified_base (13)..(20): a, c, t, g, unknown or other
  modified_base (73)..(81): a, c, t, g, unknown or other

SEQ ID NO: 1617 - DNA, 109 bp, Homo sapiens; identical to SEQ ID NO: 1598
  modified_base (13)..(20): a, c, t, g, unknown or other
  modified_base (89)..(97): a, c, t, g, unknown or other

SEQ ID NO: 1618 - DNA, 113 bp, Homo sapiens; identical to SEQ ID NO: 1609
  modified_base (13)..(20): a, c, t, g, unknown or other
  modified_base (93)..(101): a, c, t, g, unknown or other

SEQ ID NO: 1619 - DNA, 72 bp, Homo sapiens
  modified_base (49)..(56): a, c, t, g, unknown or other
tccttccttccttccttccttccttccttccttccttccttccttcctnnnnnnnnttctttctttctttct

SEQ ID NO: 1620 - DNA, 76 bp, Homo sapiens
  modified_base (53)..(60): a, c, t, g, unknown or other
tccttccttccttccttccttccttccttccttccttccttccttccttcctnnnnnnnnttctttctttctttct

SEQ ID NO: 1621 - DNA, 48 bp, Homo sapiens
tctatctatctatctatctatctatctatctatctatctatctatcta

SEQ ID NO: 1622 - DNA, 52 bp, Homo sapiens; identical to SEQ ID NO: 109

SEQ ID NO: 1623 - DNA, 52 bp, Homo sapiens; identical to SEQ ID NO: 109

SEQ ID NO: 1624 - DNA, 48 bp, Homo sapiens; identical to SEQ ID NO: 1621

SEQ ID NO: 1625 - DNA, 44 bp, Homo sapiens
tctatctatctatctatctatctatctatctatctatctatcta

SEQ ID NO: 1626 - DNA, 48 bp, Homo sapiens; identical to SEQ ID NO: 1621

SEQ ID NO: 1627 - DNA, 44 bp, Homo sapiens; identical to SEQ ID NO: 1104

SEQ ID NO: 1628 - DNA, 40 bp, Homo sapiens; identical to SEQ ID NO: 1246

SEQ ID NO: 1629 - DNA, 48 bp, Homo sapiens; identical to SEQ ID NO: 137

SEQ ID NO: 1630 - DNA, 52 bp, Homo sapiens
ttatttatttatttatttatttatttatttatttatttatttatttatttat

SEQ ID NO: 1631 - DNA, 48 bp, Homo sapiens; identical to SEQ ID NO: 137

SEQ ID NO: 1632 - DNA, 44 bp, Homo sapiens
ttatttatttatttatttatttatttatttatttatttatttat

SEQ ID NO: 1633 - DNA, 44 bp, Homo sapiens; identical to SEQ ID NO: 1632

SEQ ID NO: 1634 - DNA, 40 bp, Homo sapiens
ttatttatttatttatttatttatttatttatttatttat

SEQ ID NO: 1635 - DNA, 44 bp, Homo sapiens; identical to SEQ ID NO: 1632

SEQ ID NO: 1636 - DNA, 48 bp, Homo sapiens; identical to SEQ ID NO: 137

SEQ ID NO: 1637 - DNA, 48 bp, Homo sapiens; identical to SEQ ID NO: 137

SEQ ID NO: 1638 - DNA, 44 bp, Homo sapiens; identical to SEQ ID NO: 1632

SEQ ID NO: 1639 - DNA, 63 bp, Homo sapiens
tatctatctatctatctatctatctatctatctatctatctatctatcttctatctatctatc

SEQ ID NO: 1640 - DNA, 67 bp, Homo sapiens
tatctatctatctatctatctatctatctatctatctatctatctatctatcttctatctatctatc

SEQ ID NO: 1641 - DNA, 63 bp, Homo sapiens; identical to SEQ ID NO: 1639

SEQ ID NO: 1642 - DNA, 59 bp, Homo sapiens
tatctatctatctatctatctatctatctatctatctatctatcttctatctatctatc

SEQ ID NO: 1643 - DNA, 71 bp, Homo sapiens
tatctatctatctatctatctatctatctatctatctatctatctatctatctatcttctatctatctatc

SEQ ID NO: 1644 - DNA, 67 bp, Homo sapiens; identical to SEQ ID NO: 1640

SEQ ID NO: 1645 - DNA, 67 bp, Homo sapiens; identical to SEQ ID NO: 1640

SEQ ID NO: 1646 - DNA, 63 bp, Homo sapiens; identical to SEQ ID NO: 1639

SEQ ID NO: 1647 - DNA, 71 bp, Homo sapiens; identical to SEQ ID NO: 1643

SEQ ID NO: 1648 - DNA, 67 bp, Homo sapiens; identical to SEQ ID NO: 1640

SEQ ID NO: 1649 - DNA, 63 bp, Homo sapiens; identical to SEQ ID NO: 1639

SEQ ID NO: 1650 - DNA, 67 bp, Homo sapiens; identical to SEQ ID NO: 1640

SEQ ID NO: 1651 - DNA, 169 bp, Homo sapiens
  modified_base (57)..(98): a, c, t, g, unknown or other
  modified_base (123)..(157): a, c, t, g, unknown or other
agatagatagatgatagatagatagatagatagatagatagatagatagatagatannnnnnnnnnnnnnnnnnnnnnnnnnnnnnnnnnnnnnnnnnatgtatgtatgtatgtatggatggnnnnnnnnnnnnnnnnnnnnnnnnnnnnnnnnnnngaaagaaagaaa

SEQ ID NO: 1652 - DNA, 173 bp, Homo sapiens
  modified_base (61)..(102): a, c, t, g, unknown or other
  modified_base (127)..(161): a, c, t, g, unknown or other
agatagatagatgatagatagatagatagatagatagatagatagatagatagatagatannnnnnnnnnnnnnnnnnnnnnnnnnnnnnnnnnnnnnnnnnatgtatgtatgtatgtatggatggnnnnnnnnnnnnnnnnnnnnnnnnnnnnnnnnnnngaaagaaagaaa

SEQ ID NO: 1653 - DNA, 185 bp, Homo sapiens
  modified_base (73)..(114): a, c, t, g, unknown or other
  modified_base (139)..(173): a, c, t, g, unknown or other
agatagatagatgatagatagatagatagatagatagatagatagatagatagatagatagatagatagatannnnnnnnnnnnnnnnnnnnnnnnnnnnnnnnnnnnnnnnnnatgtatgtatgtatggatggatggnnnnnnnnnnnnnnnnnnnnnnnnnnnnnnnnnnngaaagaaagaaa

SEQ ID NO: 1654 - DNA, 181 bp, Homo sapiens
  modified_base (69)..(110): a, c, t, g, unknown or other
  modified_base (135)..(169): a, c, t, g, unknown or other
agatagatagatgatagatagatagatagatagatagatagatagatagatagatagatagatagatannnnnnnnnnnnnnnnnnnnnnnnnnnnnnnnnnnnnnnnnnatgtatgtatgtatggatggatggnnnnnnnnnnnnnnnnnnnnnnnnnnnnnnnnnnngaaagaaagaaa

SEQ ID NO: 1655 - DNA, 185 bp, Homo sapiens; identical to SEQ ID NO: 1653
  modified_base (73)..(114): a, c, t, g, unknown or other
  modified_base (139)..(173): a, c, t, g, unknown or other

SEQ ID NO: 1656 - DNA, 181 bp, Homo sapiens; identical to SEQ ID NO: 1654
  modified_base (69)..(110): a, c, t, g, unknown or other
  modified_base (135)..(169): a, c, t, g, unknown or other

SEQ ID NO: 1657 - DNA, 173 bp, Homo sapiens; identical to SEQ ID NO: 1652
  modified_base (61)..(102): a, c, t, g, unknown or other
  modified_base (127)..(161): a, c, t, g, unknown or other

SEQ ID NO: 1658 - DNA, 169 bp, Homo sapiens; identical to SEQ ID NO: 1651
  modified_base (57)..(98): a, c, t, g, unknown or other
  modified_base (123)..(157): a, c, t, g, unknown or other

SEQ ID NO: 1659 - DNA, 177 bp, Homo sapiens
  modified_base (65)..(106): a, c, t, g, unknown or other
  modified_base (131)..(165): a, c, t, g, unknown or other
agatagatagatgatagatagatagatagatagatagatagatagatagatagatagatagatannnnnnnnnnnnnnnnnnnnnnnnnnnnnnnnnnnnnnnnnnatgtatgtatgtatggatggatggnnnnnnnnnnnnnnnnnnnnnnnnnnnnnnnnnnngaaagaaagaaa

SEQ ID NO: 1660 - DNA, 181 bp, Homo sapiens; identical to SEQ ID NO: 1654
  modified_base (69)..(110): a, c, t, g, unknown or other
  modified_base (135)..(169): a, c, t, g, unknown or other

SEQ ID NO: 1661 - DNA, 185 bp, Homo sapiens; identical to SEQ ID NO: 1653
  modified_base (73)..(114): a, c, t, g, unknown or other
  modified_base (139)..(173): a, c, t, g, unknown or other

SEQ ID NO: 1662 - DNA, 189 bp, Homo sapiens
  modified_base (77)..(118): a, c, t, g, unknown or other
  modified_base (143)..(177): a, c, t, g, unknown or other
agatagatagatgatagatagatagatagatagatagatagatagatagatagatagatagatagatagatagatannnnnnnnnnnnnnnnnnnnnnnnnnnnnnnnnnnnnnnnnnatgtatgtatgtatggatggatggnnnnnnnnnnnnnnnnnnnnnnnnnnnnnnnnnnngaaagaaagaaa

SEQ ID NO: 1663 - DNA, 177 bp, Homo sapiens
  modified_base (65)..(106): a, c, t, g, unknown or other
  modified_base (131)..(165): a, c, t, g, unknown or other
agatagatagatgatagatagatagatagatagatagatagatagatagatagatagatagatannnnnnnnnnnnnnnnnnnnnnnnnnnnnnnnnnnnnnnnnnatgtatgtatgtatgtatggatggnnnnnnnnnnnnnnnnnnnnnnnnnnnnnnnnnnngaaagaaagaaa

SEQ ID NO: 1664 - DNA, 173 bp, Homo sapiens; identical to SEQ ID NO: 1652
  modified_base (61)..(102): a, c, t, g, unknown or other
  modified_base (127)..(161): a, c, t, g, unknown or other

SEQ ID NO: 1665 - DNA, 185 bp, Homo sapiens; identical to SEQ ID NO: 1653
  modified_base (73)..(114): a, c, t, g, unknown or other
  modified_base (139)..(173): a, c, t, g, unknown or other

SEQ ID NO: 1666 - DNA, 181 bp, Homo sapiens; identical to SEQ ID NO: 1654
  modified_base (69)..(110): a, c, t, g, unknown or other
  modified_base (135)..(169): a, c, t, g, unknown or other

SEQ ID NO: 1667 - DNA, 177 bp, Homo sapiens; identical to SEQ ID NO: 1659
  modified_base (65)..(106): a, c, t, g, unknown or other
  modified_base (131)..(165): a, c, t, g, unknown or other

SEQ ID NO: 1668 - DNA, 173 bp, Homo sapiens
  modified_base (61)..(102): a, c, t, g, unknown or other
  modified_base (127)..(161): a, c, t, g, unknown or other
agatagatagatgatagatagatagatagatagatagatagatagatagatagatagatannnnnnnnnnnnnnnnnnnnnnnnnnnnnnnnnnnnnnnnnnatgtatgtatgtatggatggatggnnnnnnnnnnnnnnnnnnnnnnnnnnnnnnnnnnngaaagaaagaaa

SEQ ID NO: 1669 - DNA, 169 bp, Homo sapiens; identical to SEQ ID NO: 1651
  modified_base (57)..(98): a, c, t, g, unknown or other
  modified_base (123)..(157): a, c, t, g, unknown or other

SEQ ID NO: 1670 - DNA, 173 bp, Homo sapiens; identical to SEQ ID NO: 1652
  modified_base (61)..(102): a, c, t, g, unknown or other
  modified_base (127)..(161): a, c, t, g, unknown or other

SEQ ID NO: 1671 - DNA, 177 bp, Homo sapiens; identical to SEQ ID NO: 1663
  modified_base (65)..(106): a, c, t, g, unknown or other
  modified_base (131)..(165): a, c, t, g, unknown or other

SEQ ID NO: 1672 - DNA, 173 bp, Homo sapiens; identical to SEQ ID NO: 1652
  modified_base (61)..(102): a, c, t, g, unknown or other
  modified_base (127)..(161): a, c, t, g, unknown or other

SEQ ID NO: 1673 - DNA, 176 bp, Homo sapiens
  modified_base (13)..(35): a, c, t, g, unknown or other
  modified_base (48)..(80): a, c, t, g, unknown or other
  modified_base (93)..(108): a, c, t, g, unknown or other
ttccttccttccnnnnnnnnnnnnnnnnnnnnnnnttctttctttctnnnnnnnnnnnnnnnnnnnnnnnnnnnnnnnnnttccttccttccnnnnnnnnnnnnnnnnttctttctttctttctttctttctttctttctttctttctttctttctttctttctttctttctttct

SEQ ID NO: 1674 - DNA, 180 bp, Homo sapiens
  modified_base (13)..(35): a, c, t, g, unknown or other
  modified_base (48)..(80): a, c, t, g, unknown or other
  modified_base (93)..(108): a, c, t, g, unknown or other
ttccttccttccnnnnnnnnnnnnnnnnnnnnnnnttctttctttctnnnnnnnnnnnnnnnnnnnnnnnnnnnnnnnnnttccttccttccnnnnnnnnnnnnnnnnttctttctttctttctttctttctttctttctttctttctttctttctttctttctttctttctttctttct

SEQ ID NO: 1675 - DNA, 164 bp, Homo sapiens
  modified_base (13)..(35): a, c, t, g, unknown or other
  modified_base (48)..(80): a, c, t, g, unknown or other
  modified_base (93)..(108): a, c, t, g, unknown or other
ttccttccttccnnnnnnnnnnnnnnnnnnnnnnnttctttctttctnnnnnnnnnnnnnnnnnnnnnnnnnnnnnnnnnttccttccttccnnnnnnnnnnnnnnnnttctttctttctttctttctttctttctttctttctttctttctttctttctttct

SEQ ID NO: 1676 - DNA, 160 bp, Homo sapiens
  modified_base (13)..(35): a, c, t, g, unknown or other
  modified_base (48)..(80): a, c, t, g, unknown or other
  modified_base (93)..(108): a, c, t, g, unknown or other
ttccttccttccnnnnnnnnnnnnnnnnnnnnnnnttctttctttctnnnnnnnnnnnnnnnnnnnnnnnnnnnnnnnnnttccttccttccnnnnnnnnnnnnnnnnttctttctttctttctttctttctttctttctttctttctttctttctttct

SEQ ID NO: 1677 - DNA, 172 bp, Homo sapiens
  modified_base (13)..(35): a, c, t, g, unknown or other
  modified_base (48)..(80): a, c, t, g, unknown or other
  modified_base (93)..(108): a, c, t, g, unknown or other
ttccttccttccnnnnnnnnnnnnnnnnnnnnnnnttctttctttctnnnnnnnnnnnnnnnnnnnnnnnnnnnnnnnnnttccttccttccnnnnnnnnnnnnnnnnttctttctttctttctttctttctttctttctttctttctttctttctttctttctttctttct

SEQ ID NO: 1678 - DNA, 176 bp, Homo sapiens; identical to SEQ ID NO: 1673
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1679 - DNA, 176 bp, Homo sapiens; identical to SEQ ID NO: 1673
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1680 - DNA, 172 bp, Homo sapiens; identical to SEQ ID NO: 1677
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1681 - DNA, 180 bp, Homo sapiens; identical to SEQ ID NO: 1674
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1682 - DNA, 176 bp, Homo sapiens; identical to SEQ ID NO: 1673
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1683 - DNA, 172 bp, Homo sapiens; identical to SEQ ID NO: 1677
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1684 - DNA, 164 bp, Homo sapiens; identical to SEQ ID NO: 1675
  modified_base (13)..(35): a, c, t, g, unknown or other
  modified_base (48)..(80): a, c, t, g, unknown or other
  modified_base (93)..(108): a, c, t, g, unknown or other

SEQ ID NO: 1685 - DNA, 281 bp, Homo sapiens
  modified_base (62)..(117): a, c, t, g, unknown or other
  modified_base (182)..(191): a, c, t, g, unknown or other
  modified_base (256)..(269): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1686 - DNA, 285 bp, Homo sapiens
  modified_base (62)..(117): a, c, t, g, unknown or other
  modified_base (186)..(195): a, c, t, g, unknown or other
  modified_base (260)..(273): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1687 - DNA, 285 bp, Homo sapiens
  modified_base (66)..(121): a, c, t, g, unknown or other
  modified_base (182)..(191): a, c, t, g, unknown or other
  modified_base (260)..(273): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1688 - DNA, 289 bp, Homo sapiens
  modified_base (66)..(121): a, c, t, g, unknown or other
  modified_base (182)..(191): a, c, t, g, unknown or other
  modified_base (264)..(277): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1689 - DNA, 301 bp, Homo sapiens
  modified_base (66)..(121): a, c, t, g, unknown or other
  modified_base (190)..(199): a, c, t, g, unknown or other
  modified_base (276)..(289): a, c, t, g, unknown or other
ccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttctttctttctttcnnnnnnnnnnnnnntttctttctttc

SEQ ID NO: 1690 - DNA, 305 bp, Homo sapiens
  modified_base (66)..(121): a, c, t, g, unknown or other
  modified_base (194)..(203): a, c, t, g, unknown or other
  modified_base (280)..(293): a, c, t, g, unknown or other
ccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttcnnnnnnnnnnccttccttccttcctttctctttctttctttctttctttctttctttctttctttctttctttctttctttctttcnnnnnnnnnnnnnntttctttctttc

SEQ ID NO: 1691 - DNA, 301 bp, Homo sapiens
  modified_base (74)..(129): a, c, t, g, unknown or other
  modified_base (194)..(203): a, c, t, g, unknown or other
  modified_base (276)..(289): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1692 - DNA, 297 bp, Homo sapiens
  modified_base (70)..(125): a, c, t, g, unknown or other
  modified_base (190)..(199): a, c, t, g, unknown or other
  modified_base (272)..(285): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1693 - DNA, 289 bp, Homo sapiens
  modified_base (74)..(129): a, c, t, g, unknown or other
  modified_base (186)..(195): a, c, t, g, unknown or other
  modified_base (264)..(277): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1694 - DNA, 285 bp, Homo sapiens
  modified_base (74)..(129): a, c, t, g, unknown or other
  modified_base (186)..(195): a, c, t, g, unknown or other
  modified_base (260)..(273): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1695 - DNA, 293 bp, Homo sapiens
  modified_base (66)..(121): a, c, t, g, unknown or other
  modified_base (190)..(199): a, c, t, g, unknown or other
  modified_base (268)..(281): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1696 - DNA, 289 bp, Homo sapiens
  modified_base (66)..(121): a, c, t, g, unknown or other
  modified_base (190)..(199): a, c, t, g, unknown or other
  modified_base (264)..(277): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1697 - DNA, 285 bp, Homo sapiens
  modified_base (62)..(117): a, c, t, g, unknown or other
  modified_base (190)..(199): a, c, t, g, unknown or other
  modified_base (260)..(273): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttcnnnnnnnnnnccttccttccttcctttctctttctttctttctttctttctttctttctttctttctttcnnnnnnnnnnnnnntttctttctttc

SEQ ID NO: 1698 - DNA, 289 bp, Homo sapiens
  modified_base (62)..(117): a, c, t, g, unknown or other
  modified_base (194)..(203): a, c, t, g, unknown or other
  modified_base (264)..(277): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttctttcnnnnnnnnnnccttccttccttcctttctctttctttctttctttctttctttctttctttctttctttcnnnnnnnnnnnnnntttctttctttc

SEQ ID NO: 1699 - DNA, 293 bp, Homo sapiens
  modified_base (70)..(125): a, c, t, g, unknown or other
  modified_base (194)..(203): a, c, t, g, unknown or other
  modified_base (268)..(281): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1700 - DNA, 289 bp, Homo sapiens
  modified_base (70)..(125): a, c, t, g, unknown or other
  modified_base (194)..(203): a, c, t, g, unknown or other
  modified_base (264)..(277): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttcnnnnnnnnnnnnnntttctttctttc

SEQ ID NO: 1701 - DNA, 293 bp, Homo sapiens
  modified_base (70)..(125): a, c, t, g, unknown or other
  modified_base (190)..(199): a, c, t, g, unknown or other
  modified_base (268)..(281): a, c, t, g, unknown or other
ccttccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1702 - DNA, 297 bp, Homo sapiens
  modified_base (70)..(125): a, c, t, g, unknown or other
  modified_base (194)..(203): a, c, t, g, unknown or other
  modified_base (272)..(285): a, c, t, g, unknown or other
ccttccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1703 - DNA, 293 bp, Homo sapiens
  modified_base (74)..(129): a, c, t, g, unknown or other
  modified_base (194)..(203): a, c, t, g, unknown or other
  modified_base (268)..(281): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1704 - DNA, 301 bp, Homo sapiens
  modified_base (74)..(129): a, c, t, g, unknown or other
  modified_base (202)..(211): a, c, t, g, unknown or other
  modified_base (276)..(289): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1705 - DNA, 293 bp, Homo sapiens; identical to SEQ ID NO: 1695
  modified_base (66)..(121): a, c, t, g, unknown or other
  modified_base (190)..(199): a, c, t, g, unknown or other
  modified_base (268)..(281): a, c, t, g, unknown or other

SEQ ID NO: 1706 - DNA, 289 bp, Homo sapiens
  modified_base (66)..(121): a, c, t, g, unknown or other
  modified_base (186)..(195): a, c, t, g, unknown or other
  modified_base (264)..(277): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1707 - DNA, 285 bp, Homo sapiens; identical to SEQ ID NO: 1687
  modified_base (66)..(121): a, c, t, g, unknown or other
  modified_base (182)..(191): a, c, t, g, unknown or other
  modified_base (260)..(273): a, c, t, g, unknown or other

SEQ ID NO: 1708 - DNA, 281 bp, Homo sapiens
  modified_base (66)..(121): a, c, t, g, unknown or other
  modified_base (182)..(191): a, c, t, g, unknown or other
  modified_base (256)..(269): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1709 - DNA, 289 bp, Homo sapiens
  modified_base (70)..(125): a, c, t, g, unknown or other
  modified_base (186)..(195): a, c, t, g, unknown or other
  modified_base (264)..(277): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1710 - DNA, 285 bp, Homo sapiens
  modified_base (70)..(125): a, c, t, g, unknown or other
  modified_base (182)..(191): a, c, t, g, unknown or other
  modified_base (260)..(273): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1711 - DNA, 289 bp, Homo sapiens
  modified_base (74)..(129): a, c, t, g, unknown or other
  modified_base (190)..(199): a, c, t, g, unknown or other
  modified_base (264)..(277): a, c, t, g, unknown or other
ccttccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1712 - DNA, 285 bp, Homo sapiens; identical to SEQ ID NO: 1694
  modified_base (74)..(129): a, c, t, g, unknown or other
  modified_base (186)..(195): a, c, t, g, unknown or other
  modified_base (260)..(273): a, c, t, g, unknown or other

SEQ ID NO: 1713 - DNA, 285 bp, Homo sapiens; identical to SEQ ID NO: 1697
  modified_base (62)..(117): a, c, t, g, unknown or other
  modified_base (190)..(199): a, c, t, g, unknown or other
  modified_base (260)..(273): a, c, t, g, unknown or other

SEQ ID NO: 1714 - DNA, 281 bp, Homo sapiens
  modified_base (62)..(117): a, c, t, g, unknown or other
  modified_base (186)..(195): a, c, t, g, unknown or other
  modified_base (256)..(269): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttcnnnnnnnnnnnnnntttctttctttc

SEQ ID NO: 1715 - DNA, 289 bp, Homo sapiens; identical to SEQ ID NO: 1706
  modified_base (66)..(121): a, c, t, g, unknown or other
  modified_base (186)..(195): a, c, t, g, unknown or other
  modified_base (264)..(277): a, c, t, g, unknown or other

SEQ ID NO: 1716 - DNA, 293 bp, Homo sapiens; identical to SEQ ID NO: 1695
  modified_base (66)..(121): a, c, t, g, unknown or other
  modified_base (190)..(199): a, c, t, g, unknown or other
  modified_base (268)..(281): a, c, t, g, unknown or other

SEQ ID NO: 1717 - DNA, 301 bp, Homo sapiens
  modified_base (66)..(121): a, c, t, g, unknown or other
  modified_base (194)..(203): a, c, t, g, unknown or other
  modified_base (276)..(289): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1718 - DNA, 305 bp, Homo sapiens
  modified_base (66)..(121): a, c, t, g, unknown or other
  modified_base (198)..(207): a, c, t, g, unknown or other
  modified_base (280)..(293): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1719 - DNA, 305 bp, Homo sapiens
  modified_base (70)..(125): a, c, t, g, unknown or other
  modified_base (214)..(223): a, c, t, g, unknown or other
  modified_base (280)..(293): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttctttctttctttctttcnnnnnnnnnnccttccttccttcctttctctttctttctttctttctttctttctttctttctttcnnnnnnnnnnnnnntttctttctttc

SEQ ID NO: 1720 - DNA, 301 bp, Homo sapiens
  modified_base (70)..(125): a, c, t, g, unknown or other
  modified_base (210)..(219): a, c, t, g, unknown or other
  modified_base (276)..(289): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttctttctttctttcnnnnnnnnnnccttccttccttcctttctctttctttctttctttctttctttctttctttctttcnnnnnnnnnnnnnntttctttctttc

SEQ ID NO: 1721 - DNA, 293 bp, Homo sapiens
  modified_base (66)..(121): a, c, t, g, unknown or other
  modified_base (186)..(195): a, c, t, g, unknown or other
  modified_base (268)..(281): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1722 - DNA, 297 bp, Homo sapiens
  modified_base (66)..(121): a, c, t, g, unknown or other
  modified_base (186)..(195): a, c, t, g, unknown or other
  modified_base (272)..(285): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttctttctttcnnnnnnnnnnnnnntttctttctttc

SEQ ID NO: 1723 - DNA, 301 bp, Homo sapiens
  modified_base (66)..(121): a, c, t, g, unknown or other
  modified_base (198)..(207): a, c, t, g, unknown or other
  modified_base (276)..(289): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1724 - DNA, 297 bp, Homo sapiens
  modified_base (66)..(121): a, c, t, g, unknown or other
  modified_base (194)..(203): a, c, t, g, unknown or other
  modified_base (272)..(285): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1725 - DNA, 293 bp, Homo sapiens; identical to SEQ ID NO: 1721
  modified_base (66)..(121): a, c, t, g, unknown or other
  modified_base (186)..(195): a, c, t, g, unknown or other
  modified_base (268)..(281): a, c, t, g, unknown or other

SEQ ID NO: 1726 - DNA, 297 bp, Homo sapiens; identical to SEQ ID NO: 1722
  modified_base (66)..(121): a, c, t, g, unknown or other
  modified_base (186)..(195): a, c, t, g, unknown or other
  modified_base (272)..(285): a, c, t, g, unknown or other

SEQ ID NO: 1727 - DNA, 297 bp, Homo sapiens; identical to SEQ ID NO: 1724
  modified_base (66)..(121): a, c, t, g, unknown or other
  modified_base (194)..(203): a, c, t, g, unknown or other
  modified_base (272)..(285): a, c, t, g, unknown or other

SEQ ID NO: 1728 - DNA, 301 bp, Homo sapiens; identical to SEQ ID NO: 1723
  modified_base (66)..(121): a, c, t, g, unknown or other
  modified_base (198)..(207): a, c, t, g, unknown or other
  modified_base (276)..(289): a, c, t, g, unknown or other

SEQ ID NO: 1729 - DNA, 285 bp, Homo sapiens
  modified_base (62)..(117): a, c, t, g, unknown or other
  modified_base (182)..(191): a, c, t, g, unknown or other
  modified_base (260)..(273): a, c, t, g, unknown or other
ccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1730 - DNA, 289 bp, Homo sapiens
  modified_base (62)..(117): a, c, t, g, unknown or other
  modified_base (182)..(191): a, c, t, g, unknown or other
  modified_base (264)..(277): a, c, t, g, unknown or other
ccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1731 - DNA, 281 bp, Homo sapiens
  modified_base (66)..(121): a, c, t, g, unknown or other
  modified_base (182)..(191): a, c, t, g, unknown or other
  modified_base (256)..(269): a, c, t, g, unknown or other
ccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1732 - DNA, 285 bp, Homo sapiens
  modified_base (66)..(121): a, c, t, g, unknown or other
  modified_base (182)..(191): a, c, t, g, unknown or other
  modified_base (260)..(273): a, c, t, g, unknown or other
ccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1733 - DNA, 289 bp, Homo sapiens; identical to SEQ ID NO: 1709
  modified_base (70)..(125): a, c, t, g, unknown or other
  modified_base (186)..(195): a, c, t, g, unknown or other
  modified_base (264)..(277): a, c, t, g, unknown or other

SEQ ID NO: 1734 - DNA, 293 bp, Homo sapiens
  modified_base (70)..(125): a, c, t, g, unknown or other
  modified_base (186)..(195): a, c, t, g, unknown or other
  modified_base (268)..(281): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1735 - DNA, 285 bp, Homo sapiens; identical to SEQ ID NO: 1697
  modified_base (62)..(117): a, c, t, g, unknown or other
  modified_base (190)..(199): a, c, t, g, unknown or other
  modified_base (260)..(273): a, c, t, g, unknown or other

SEQ ID NO: 1736 - DNA, 289 bp, Homo sapiens; identical to SEQ ID NO: 1698
  modified_base (62)..(117): a, c, t, g, unknown or other
  modified_base (194)..(203): a, c, t, g, unknown or other
  modified_base (264)..(277): a, c, t, g, unknown or other

SEQ ID NO: 1737 - DNA, 277 bp, Homo sapiens
  modified_base (62)..(117): a, c, t, g, unknown or other
  modified_base (182)..(191): a, c, t, g, unknown or other
  modified_base (252)..(265): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttcnnnnnnnnnnnnnntttctttctttc

SEQ ID NO: 1738 - DNA, 281 bp, Homo sapiens; identical to SEQ ID NO: 1685
  modified_base (62)..(117): a, c, t, g, unknown or other
  modified_base (182)..(191): a, c, t, g, unknown or other
  modified_base (256)..(269): a, c, t, g, unknown or other

SEQ ID NO: 1739 - DNA, 293 bp, Homo sapiens; identical to SEQ ID NO: 1734
  modified_base (70)..(125): a, c, t, g, unknown or other
  modified_base (186)..(195): a, c, t, g, unknown or other
  modified_base (268)..(281): a, c, t, g, unknown or other

SEQ ID NO: 1740 - DNA, 297 bp, Homo sapiens; identical to SEQ ID NO: 1692
  modified_base (70)..(125): a, c, t, g, unknown or other
  modified_base (190)..(199): a, c, t, g, unknown or other
  modified_base (272)..(285): a, c, t, g, unknown or other

SEQ ID NO: 1741 - DNA, 289 bp, Homo sapiens; identical to SEQ ID NO: 1706
  modified_base (66)..(121): a, c, t, g, unknown or other
  modified_base (186)..(195): a, c, t, g, unknown or other
  modified_base (264)..(277): a, c, t, g, unknown or other

SEQ ID NO: 1742 - DNA, 293 bp, Homo sapiens; identical to SEQ ID NO: 1695
  modified_base (66)..(121): a, c, t, g, unknown or other
  modified_base (190)..(199): a, c, t, g, unknown or other
  modified_base (268)..(281): a, c, t, g, unknown or other

SEQ ID NO: 1743 - DNA, 289 bp, Homo sapiens
  modified_base (70)..(125): a, c, t, g, unknown or other
  modified_base (190)..(199): a, c, t, g, unknown or other
  modified_base (264)..(277): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1744 - DNA, 285 bp, Homo sapiens
  modified_base (70)..(125): a, c, t, g, unknown or other
  modified_base (190)..(199): a, c, t, g, unknown or other
  modified_base (260)..(273): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttcnnnnnnnnnnnnnntttctttctttc

SEQ ID NO: 1745 - DNA, 289 bp, Homo sapiens
  modified_base (70)..(125): a, c, t, g, unknown or other
  modified_base (166)..(175): a, c, t, g, unknown or other
  modified_base (264)..(277): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttcnnnnnnnnnnccttccttccttcctttctctttctttctttctttctttctttctttctttctttctttctttctttctttctttctttctttctttcnnnnnnnnnnnnnntttctttctttc

SEQ ID NO: 1746 - DNA, 285 bp, Homo sapiens
  modified_base (70)..(125): a, c, t, g, unknown or other
  modified_base (166)..(175): a, c, t, g, unknown or other
  modified_base (260)..(273): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttcnnnnnnnnnnccttccttccttcctttctctttctttctttctttctttctttctttctttctttctttctttctttctttctttctttctttcnnnnnnnnnnnnnntttctttctttc

SEQ ID NO: 1747 - DNA, 297 bp, Homo sapiens; identical to SEQ ID NO: 1692
  modified_base (70)..(125): a, c, t, g, unknown or other
  modified_base (190)..(199): a, c, t, g, unknown or other
  modified_base (272)..(285): a, c, t, g, unknown or other

SEQ ID NO: 1748 - DNA, 301 bp, Homo sapiens
  modified_base (70)..(125): a, c, t, g, unknown or other
  modified_base (194)..(203): a, c, t, g, unknown or other
  modified_base (276)..(289): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1749 - DNA, 285 bp, Homo sapiens; identical to SEQ ID NO: 1687
  modified_base (66)..(121): a, c, t, g, unknown or other
  modified_base (182)..(191): a, c, t, g, unknown or other
  modified_base (260)..(273): a, c, t, g, unknown or other

SEQ ID NO: 1750 - DNA, 281 bp, Homo sapiens
  modified_base (66)..(121): a, c, t, g, unknown or other
  modified_base (178)..(187): a, c, t, g, unknown or other
  modified_base (256)..(269): a, c, t, g, unknown or other
ccttccttccttccttccttccttccttccttccttccttccttcctttcttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1751 - DNA, 293 bp, Homo sapiens
  modified_base (70)..(125): a, c, t, g, unknown or other
  modified_base (190)..(199): a, c, t, g, unknown or other
  modified_base (268)..(281): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1752 - DNA, 297 bp, Homo sapiens
  modified_base (70)..(125): a, c, t, g, unknown or other
  modified_base (194)..(203): a, c, t, g, unknown or other
  modified_base (272)..(285): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1753 - DNA, 289 bp, Homo sapiens; identical to SEQ ID NO: 1706
  modified_base (66)..(121): a, c, t, g, unknown or other
  modified_base (186)..(195): a, c, t, g, unknown or other
  modified_base (264)..(277): a, c, t, g, unknown or other

SEQ ID NO: 1754 - DNA, 293 bp, Homo sapiens; identical to SEQ ID NO: 1695
  modified_base (66)..(121): a, c, t, g, unknown or other
  modified_base (190)..(199): a, c, t, g, unknown or other
  modified_base (268)..(281): a, c, t, g, unknown or other

SEQ ID NO: 1755 - DNA, 297 bp, Homo sapiens; identical to SEQ ID NO: 1752
  modified_base (70)..(125): a, c, t, g, unknown or other
  modified_base (194)..(203): a, c, t, g, unknown or other
  modified_base (272)..(285): a, c, t, g, unknown or other

SEQ ID NO: 1756 - DNA, 293 bp, Homo sapiens; identical to SEQ ID NO: 1751
  modified_base (70)..(125): a, c, t, g, unknown or other
  modified_base (190)..(199): a, c, t, g, unknown or other
  modified_base (268)..(281): a, c, t, g, unknown or other

SEQ ID NO: 1757 - DNA, 289 bp, Homo sapiens
  modified_base (62)..(117): a, c, t, g, unknown or other
  modified_base (182)..(191): a, c, t, g, unknown or other
  modified_base (264)..(277): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttctttcnnnnnnnnnnnnnntttctttctttc

SEQ ID NO: 1758 - DNA, 285 bp, Homo sapiens
  modified_base (62)..(117): a, c, t, g, unknown or other
  modified_base (182)..(191): a, c, t, g, unknown or other
  modified_base (260)..(273): a, c, t, g, unknown or other
ccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttctttcnnnnnnnnnnccttccttccttcctttctctttctttctttctttctttctttctttctttctttctttctttctttcnnnnnnnnnnnnnntttctttctttc

SEQ ID NO: 1759 - DNA, 289 bp, Homo sapiens; identical to SEQ ID NO: 1743
  modified_base (70)..(125): a, c, t, g, unknown or other
  modified_base (190)..(199): a, c, t, g, unknown or other
  modified_base (264)..(277): a, c, t, g, unknown or other

SEQ ID NO: 1760 - DNA, 285 bp, Homo sapiens
  modified_base (70)..(125): a, c, t, g, unknown or other
  modified_base (186)..(195): a, c, t, g, unknown or other
  modified_base (260)..(273): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1761 - DNA, 281 bp, Homo sapiens
  modified_base (70)..(125): a, c, t, g, unknown or other
  modified_base (182)..(191): a, c, t, g, unknown or other
  modified_base (256)..(269): a, c, t, g, unknown or other
ccttccttccttccttccttccttccttccttccttccttccttcctttcttccttccttccttccttcnnnnnnnnnnnnnnnnnnnnnnnnnnnnnnnnnnnnnnnnnnnnnnnnnnnnnnnntttctttctttctttctttctttctttctttctttctttctttctttctttctttcnnnnnnnnnnccttccttccttcctttctctttctttctttctttctttctttctttctttctttctttctttcnnnnnnnnnnnnnntttctttctttc

SEQ ID NO: 1762 - DNA, 285 bp, Homo sapiens; identical to SEQ ID NO: 1710
  modified_base (70)..(125): a, c, t, g, unknown or other
  modified_base (182)..(191): a, c, t, g, unknown or other
  modified_base (260)..(273): a, c, t, g, unknown or other

SEQ ID NO: 1763 - DNA, 52 bp, Homo sapiens; identical to SEQ ID NO: 110

SEQ ID NO: 1764 - DNA, 48 bp, Homo sapiens; identical to SEQ ID NO: 1398

SEQ ID NO: 1765 - DNA, 52 bp, Homo sapiens; identical to SEQ ID NO: 110

SEQ ID NO: 1766 - DNA, 48 bp, Homo sapiens; identical to SEQ ID NO: 1398

SEQ ID NO: 1767 - DNA, 48 bp, Homo sapiens; identical to SEQ ID NO: 1398

SEQ ID NO: 1768 - DNA, 44 bp, Homo sapiens; identical to SEQ ID NO: 1399

SEQ ID NO: 1769 - DNA, 48 bp, Homo sapiens; identical to SEQ ID NO: 1398

SEQ ID NO: 1770 - DNA, 52 bp, Homo sapiens; identical to SEQ ID NO: 110

SEQ ID NO: 1771 - DNA, 56 bp, Homo sapiens; identical to SEQ ID NO: 91

SEQ ID NO: 1772 - DNA, 52 bp, Homo sapiens; identical to SEQ ID NO: 110

SEQ ID NO: 1773 - DNA, 48 bp, Homo sapiens; identical to SEQ ID NO: 1398

SEQ ID NO: 1774 - DNA, 44 bp, Homo sapiens; identical to SEQ ID NO: 1399

SEQ ID NO: 1775 - DNA, 48 bp, Homo sapiens; identical to SEQ ID NO: 1398

SEQ ID NO: 1776 - DNA, 44 bp, Homo sapiens; identical to SEQ ID NO: 1399

SEQ ID NO: 1777 - DNA, 100 bp, Homo sapiens
  modified_base (61)..(68): a, c, t, g, unknown or other
agatagatagatagatagatagatagatagatagatagatagatagatagatagatagatnnnnnnnnagacagacagacaggtagatagatagatagat

SEQ ID NO: 1778 - DNA, 96 bp, Homo sapiens
  modified_base (57)..(64): a, c, t, g, unknown or other
agatagatagatagatagatagatagatagatagatagatagatagatagatagatnnnnnnnnagacagacagacaggtagatagatagatagat

SEQ ID NO: 1779 - DNA, 96 bp, Homo sapiens; identical to SEQ ID NO: 1778
  modified_base (57)..(64): a, c, t, g, unknown or other

SEQ ID NO: 1780 - DNA, 92 bp, Homo sapiens
  modified_base (53)..(60): a, c, t, g, unknown or other
agatagatagatagatagatagatagatagatagatagatagatagatagatnnnnnnnnagacagacagacaggtagatagatagatagat

SEQ ID NO: 1781 - DNA, 100 bp, Homo sapiens; identical to SEQ ID NO: 1777
  modified_base (61)..(68): a, c, t, g, unknown or other

SEQ ID NO: 1782 - DNA, 96 bp, Homo sapiens; identical to SEQ ID NO: 1778
  modified_base (57)..(64): a, c, t, g, unknown or other

SEQ ID NO: 1783 - DNA, 96 bp, Homo sapiens; identical to SEQ ID NO: 1778
  modified_base (57)..(64): a, c, t, g, unknown or other

SEQ ID NO: 1784 - DNA, 92 bp, Homo sapiens; identical to SEQ ID NO: 1780
  modified_base (53)..(60): a, c, t, g, unknown or other

SEQ ID NO: 1785 - DNA, 92 bp, Homo sapiens; identical to SEQ ID NO: 1780
  modified_base (53)..(60): a, c, t, g, unknown or other

SEQ ID NO: 1786 - DNA, 96 bp, Homo sapiens; identical to SEQ ID NO: 1778
  modified_base (57)..(64): a, c, t, g, unknown or other

SEQ ID NO: 1787 - DNA, 152 bp, Homo sapiens
  modified_base (53)..(92): a, c, t, g, unknown or other
tctatctatctatctgtctatctatctatctatctatctatctatctatctannnnnnnnnnnnnnnnnnnnnnnnnnnnnnnnnnnnnnnntctatctatctatctatctatctatctatctatctatctatctatctatctatctatcta

SEQ ID NO: 1788 - DNA, 88 bp, Homo sapiens
  modified_base (45)..(84): a, c, t, g, unknown or other
tctatctatctatctgtctatctatctatctatctatctatctannnnnnnnnnnnnnnnnnnnnnnnnnnnnnnnnnnnnnnntcta

SEQ ID NO: 1789 - DNA, 156 bp, Homo sapiens
  modified_base (57)..(96): a, c, t, g, unknown or other
tctatctatctatctgtctatctatctatctatctatctatctatctatctatctannnnnnnnnnnnnnnnnnnnnnnnnnnnnnnnnnnnnnnntctatctatctatctatctatctatctatctatctatctatctatctatctatctatcta

SEQ ID NO: 1790 - DNA, 100 bp, Homo sapiens
  modified_base (57)..(96): a, c, t, g, unknown or other
tctatctatctatctgtctatctatctatctatctatctatctatctatctatctannnnnnnnnnnnnnnnnnnnnnnnnnnnnnnnnnnnnnnntcta

SEQ ID NO: 1791 - DNA, 152 bp, Homo sapiens
  modified_base (57)..(96): a, c, t, g, unknown or other
tctatctatctatctgtctatctatctatctatctatctatctatctatctatctannnnnnnnnnnnnnnnnnnnnnnnnnnnnnnnnnnnnnnntctatctatctatctatctatctatctatctatctatctatctatctatctatcta

SEQ ID NO: 1792 - DNA, 100 bp, Homo sapiens; identical to SEQ ID NO: 1790
  modified_base (57)..(96): a, c, t, g, unknown or other

SEQ ID NO: 1793 - DNA, 156 bp, Homo sapiens
  modified_base (61)..(100): a, c, t, g, unknown or other
tctatctatctatctgtctatctatctatctatctatctatctatctatctatctatctannnnnnnnnnnnnnnnnnnnnnnnnnnnnnnnnnnnnnnntctatctatctatctatctatctatctatctatctatctatctatctatctatcta

SEQ ID NO: 1794 - DNA, 108 bp, Homo sapiens
  modified_base (65)..(104): a, c, t, g, unknown or other
tctatctatctatctgtctatctatctatctatctatctatctatctatctatctatctatctannnnnnnnnnnnnnnnnnnnnnnnnnnnnnnnnnnnnnnntcta

SEQ ID NO: 1795 - DNA, 40 bp, Homo sapiens; identical to SEQ ID NO: 182

SEQ ID NO: 1796 - DNA, 44 bp, Homo sapiens; identical to SEQ ID NO: 123

SEQ ID NO: 1797 - DNA, 48 bp, Homo sapiens; identical to SEQ ID NO: 124

SEQ ID NO: 1798 - DNA, 44 bp, Homo sapiens; identical to SEQ ID NO: 138

SEQ ID NO: 1799 - DNA, 44 bp, Homo sapiens; identical to SEQ ID NO: 138

SEQ ID NO: 1800 - DNA, 48 bp, Homo sapiens; identical to SEQ ID NO: 124

SEQ ID NO: 1801 - DNA, 104 bp, Homo sapiens
tttctttctttctttcttctctttctttctttctttcttctttctttctttctttctttctttctttctttctttctttctttctttctttctttctttctttc

SEQ ID NO: 1802 - DNA, 100 bp, Homo sapiens
tttctttctttctttcttctctttctttctttctttcttctttctttctttctttctttctttctttctttctttctttctttctttctttctttctttc

SEQ ID NO: 1803 - DNA, 104 bp, Homo sapiens; identical to SEQ ID NO: 1801

SEQ ID NO: 1804 - DNA, 100 bp, Homo sapiens; identical to SEQ ID NO: 1802

SEQ ID NO: 1805 - DNA, 100 bp, Homo sapiens; identical to SEQ ID NO: 1802

SEQ ID NO: 1806 - DNA, 104 bp, Homo sapiens; identical to SEQ ID NO: 1801

SEQ ID NO: 1807 - DNA, 100 bp, Homo sapiens; identical to SEQ ID NO: 1802

SEQ ID NO: 1808 - DNA, 104 bp, Homo sapiens; identical to SEQ ID NO: 1801

SEQ ID NO: 1809 - DNA, 108 bp, Homo sapiens
tttctttctttctttcttctctttctttctttctttcttctttctttctttctttctttctttctttctttctttctttctttctttctttctttctttctttctttc

SEQ ID NO: 1810 - DNA, 104 bp, Homo sapiens; identical to SEQ ID NO: 1801

SEQ ID NO: 1811 - DNA, 100 bp, Homo sapiens; identical to SEQ ID NO: 1802

SEQ ID NO: 1812 - DNA, 104 bp, Homo sapiens; identical to SEQ ID NO: 1801

SEQ ID NO: 1813 - DNA, 36 bp, Homo sapiens; identical to SEQ ID NO: 127

SEQ ID NO: 1814 - DNA, 32 bp, Homo sapiens
taaataaataaataaataaataaataaataaa

SEQ ID NO: 1815 - DNA, 68 bp, Homo sapiens; identical to SEQ ID NO: 128

SEQ ID NO: 1816 - DNA, 64 bp, Homo sapiens
gatagatagatagatagatagatagatagatagatagatagatagatagacagacagacagaca

SEQ ID NO: 1817 - DNA, 52 bp, Homo sapiens; identical to SEQ ID NO: 130

SEQ ID NO: 1818 - DNA, 48 bp, Homo sapiens
ataaataaataaataaataaataaataaataaataaataaataaataa

SEQ ID NO: 1819 - DNA, 52 bp, Homo sapiens; identical to SEQ ID NO: 130

SEQ ID NO: 1820 - DNA, 48 bp, Homo sapiens; identical to SEQ ID NO: 1818

SEQ ID NO: 1821 - DNA, 52 bp, Homo sapiens; identical to SEQ ID NO: 130

SEQ ID NO: 1822 - DNA, 56 bp, Homo sapiens; identical to SEQ ID NO: 129

SEQ ID NO: 1823 - DNA, 48 bp, Homo sapiens; identical to SEQ ID NO: 124

SEQ ID NO: 1824 - DNA, 52 bp, Homo sapiens; identical to SEQ ID NO: 19

SEQ ID NO: 1825 - DNA, 48 bp, Homo sapiens
atttatttatttatttatttatttatttatttatttatttatttattt

SEQ ID NO: 1826 - DNA, 44 bp, Homo sapiens; identical to SEQ ID NO: 51

SEQ ID NO: 1827 - DNA, 48 bp, Homo sapiens; identical to SEQ ID NO: 1825

SEQ ID NO: 1828 - DNA, 44 bp, Homo sapiens; identical to SEQ ID NO: 51

SEQ ID NO: 1829 - DNA, 68 bp, Homo sapiens
tttctttctttctttctttctttctttctttctttctttctttctttctttctttctttctttctttc

SEQ ID NO: 1830 - DNA, 64 bp, Homo sapiens
tttctttctttctttctttctttctttctttctttctttctttctttctttctttctttctttc

SEQ ID NO: 1831 - DNA, 76 bp, Homo sapiens
tttctttctttctttctttctttctttctttctttctttctttctttctttctttctttctttctttctttctttc

SEQ ID NO: 1832 - DNA, 80 bp, Homo sapiens
tttctttctttctttctttctttctttctttctttctttctttctttctttctttctttctttctttctttctttctttc

SEQ ID NO: 1833 - DNA, 76 bp, Homo sapiens; identical to SEQ ID NO: 1831

SEQ ID NO: 1834 - DNA, 72 bp, Homo sapiens
tttctttctttctttctttctttctttctttctttctttctttctttctttctttctttctttctttctttc

SEQ ID NO: 1835 - DNA, 80 bp, Homo sapiens; identical to SEQ ID NO: 1832

SEQ ID NO: 1836 - DNA, 76 bp, Homo sapiens; identical to SEQ ID NO: 1831

SEQ ID NO: 1837 - DNA, 68 bp, Homo sapiens; identical to SEQ ID NO: 1829

SEQ ID NO: 1838 - DNA, 72 bp, Homo sapiens; identical to SEQ ID NO: 1834

SEQ ID NO: 1839 - DNA, 76 bp, Homo sapiens; identical to SEQ ID NO: 1831

SEQ ID NO: 1840 - DNA, 68 bp, Homo sapiens; identical to SEQ ID NO: 1829

SEQ ID NO: 1841 - DNA, 76 bp, Homo sapiens; identical to SEQ ID NO: 1831

SEQ ID NO: 1842 - DNA, 72 bp, Homo sapiens; identical to SEQ ID NO: 1834

SEQ ID NO: 1843 - DNA, 80 bp, Homo sapiens; identical to SEQ ID NO: 1832

SEQ ID NO: 1844 - DNA, 84 bp, Homo sapiens
tttctttctttctttctttctttctttctttctttctttctttctttctttctttctttctttctttctttctttctttctttc

SEQ ID NO: 1845 - DNA, 80 bp, Homo sapiens; identical to SEQ ID NO: 1832

SEQ ID NO: 1846 - DNA, 84 bp, Homo sapiens; identical to SEQ ID NO: 1844

SEQ ID NO: 1847 - DNA, 80 bp, Homo sapiens; identical to SEQ ID NO: 1832

SEQ ID NO: 1848 - DNA, 76 bp, Homo sapiens; identical to SEQ ID NO: 1831

SEQ ID NO: 1849 - DNA, 84 bp, Homo sapiens; identical to SEQ ID NO: 1844

SEQ ID NO: 1850 - DNA, 88 bp, Homo sapiens
tttctttctttctttctttctttctttctttctttctttctttctttctttctttctttctttctttctttctttctttctttctttc

SEQ ID NO: 1851 - DNA, 72 bp, Homo sapiens; identical to SEQ ID NO: 1834

SEQ ID NO: 1852 - DNA, 76 bp, Homo sapiens; identical to SEQ ID NO: 1831

SEQ ID NO: 1853 - DNA, 76 bp, Homo sapiens; identical to SEQ ID NO: 1831

SEQ ID NO: 1854 - DNA, 80 bp, Homo sapiens; identical to SEQ ID NO: 1832

SEQ ID NO: 1855 - DNA, 64 bp, Homo sapiens; identical to SEQ ID NO: 1830

SEQ ID NO: 1856 - DNA, 60 bp, Homo sapiens
tttctttctttctttctttctttctttctttctttctttctttctttctttctttctttc

SEQ ID NO: 1857 - DNA, 84 bp, Homo sapiens; identical to SEQ ID NO: 1844

SEQ ID NO: 1858 - DNA, 80 bp, Homo sapiens; identical to SEQ ID NO: 1832

SEQ ID NO: 1859 - DNA, 68 bp, Homo sapiens; identical to SEQ ID NO: 1829

SEQ ID NO: 1860 - DNA, 72 bp, Homo sapiens; identical to SEQ ID NO: 1834

SEQ ID NO: 1861 - DNA, 76 bp, Homo sapiens; identical to SEQ ID NO: 1831

SEQ ID NO: 1862 - DNA, 72 bp, Homo sapiens; identical to SEQ ID NO: 1834

SEQ ID NO: 1863 - DNA, 44 bp, Homo sapiens; identical to SEQ ID NO: 138

SEQ ID NO: 1864 - DNA, 40 bp, Homo sapiens; identical to SEQ ID NO: 141

SEQ ID NO: 1865 - DNA, 44 bp, Homo sapiens; identical to SEQ ID NO: 138

SEQ ID NO: 1866 - DNA, 40 bp, Homo sapiens; identical to SEQ ID NO: 141

SEQ ID NO: 1867 - DNA, 44 bp, Homo sapiens; identical to SEQ ID NO: 138

SEQ ID NO: 1868 - DNA, 40 bp, Homo sapiens; identical to SEQ ID NO: 141

SEQ ID NO: 1869 - DNA, 40 bp, Homo sapiens; identical to SEQ ID NO: 1634

SEQ ID NO: 1870 - DNA, 36 bp, Homo sapiens
ttatttatttatttatttatttatttatttatttat

SEQ ID NO: 1871 - DNA, 68 bp, Homo sapiens
aaagaaagaaagaaagaaagaaagaaagaaagaaagaaagaaagaaagaaagaaagaaagaaagaaag

SEQ ID NO: 1872 - DNA, 72 bp, Homo sapiens
aaagaaagaaagaaagaaagaaagaaagaaagaaagaaagaaagaaagaaagaaagaaagaaagaaagaaag

SEQ ID NO: 1873 - DNA, 76 bp, Homo sapiens
aaagaaagaaagaaagaaagaaagaaagaaagaaagaaagaaagaaagaaagaaagaaagaaagaaagaaagaaag

SEQ ID NO: 1874 - DNA, 72 bp, Homo sapiens; identical to SEQ ID NO: 1872

SEQ ID NO: 1875 - DNA, 68 bp, Homo sapiens; identical to SEQ ID NO: 1871

SEQ ID NO: 1876 - DNA, 72 bp, Homo sapiens; identical to SEQ ID NO: 1872

SEQ ID NO: 1877 - DNA, 72 bp, Homo sapiens; identical to SEQ ID NO: 1872

SEQ ID NO: 1878 - DNA, 68 bp, Homo sapiens; identical to SEQ ID NO: 1871

SEQ ID NO: 1879 - DNA, 76 bp, Homo sapiens; identical to SEQ ID NO: 1873

SEQ ID NO: 1880 - DNA, 72 bp, Homo sapiens; identical to SEQ ID NO: 1872

SEQ ID NO: 1881 - DNA, 76 bp, Homo sapiens; identical to SEQ ID NO: 1873

SEQ ID NO: 1882 - DNA, 72 bp, Homo sapiens; identical to SEQ ID NO: 1872

SEQ ID NO: 1883 - DNA, 80 bp, Homo sapiens
aaagaaagaaagaaagaaagaaagaaagaaagaaagaaagaaagaaagaaagaaagaaagaaagaaagaaagaaagaaag

SEQ ID NO: 1884 - DNA, 84 bp, Homo sapiens
aaagaaagaaagaaagaaagaaagaaagaaagaaagaaagaaagaaagaaagaaagaaagaaagaaagaaagaaagaaagaaag

SEQ ID NO: 1885 - DNA, 72 bp, Homo sapiens; identical to SEQ ID NO: 1872

SEQ ID NO: 1886 - DNA, 68 bp, Homo sapiens; identical to SEQ ID NO: 1871

SEQ ID NO: 1887 - DNA, 80 bp, Homo sapiens; identical to SEQ ID NO: 1883

SEQ ID NO: 1888 - DNA, 84 bp, Homo sapiens; identical to SEQ ID NO: 1884

SEQ ID NO: 1889 - DNA, 80 bp, Homo sapiens; identical to SEQ ID NO: 1883

SEQ ID NO: 1890 - DNA, 76 bp, Homo sapiens; identical to SEQ ID NO: 1873

SEQ ID NO: 1891 - DNA, 68 bp, Homo sapiens; identical to SEQ ID NO: 1871

SEQ ID NO: 1892 - DNA, 72 bp, Homo sapiens; identical to SEQ ID NO: 1872

SEQ ID NO: 1893 - DNA, 76 bp, Homo sapiens; identical to SEQ ID NO: 1873

SEQ ID NO: 1894 - DNA, 72 bp, Homo sapiens; identical to SEQ ID NO: 1872

SEQ ID NO: 1895 - DNA, 72 bp, Homo sapiens; identical to SEQ ID NO: 1872

SEQ ID NO: 1896 - DNA, 76 bp, Homo sapiens; identical to SEQ ID NO: 1873

SEQ ID NO: 1897 - DNA, 72 bp, Homo sapiens; identical to SEQ ID NO: 1872

SEQ ID NO: 1898 - DNA, 76 bp, Homo sapiens; identical to SEQ ID NO: 1873

SEQ ID NO: 1899 - DNA, 72 bp, Homo sapiens; identical to SEQ ID NO: 1872

SEQ ID NO: 1900 - DNA, 76 bp, Homo sapiens; identical to SEQ ID NO: 1873

SEQ ID NO: 1901 - DNA, 72 bp, Homo sapiens; identical to SEQ ID NO: 1872

SEQ ID NO: 1902 - DNA, 68 bp, Homo sapiens; identical to SEQ ID NO: 1871

SEQ ID NO: 1903 - DNA, 72 bp, Homo sapiens; identical to SEQ ID NO: 1872

SEQ ID NO: 1904 - DNA, 76 bp, Homo sapiens; identical to SEQ ID NO: 1873

SEQ ID NO: 1905 - DNA, 72 bp, Homo sapiens; identical to SEQ ID NO: 1872

SEQ ID NO: 1906 - DNA, 76 bp, Homo sapiens; identical to SEQ ID NO: 1873

SEQ ID NO: 1907 - DNA, 68 bp, Homo sapiens; identical to SEQ ID NO: 1871

SEQ ID NO: 1908 - DNA, 64 bp, Homo sapiens
aaagaaagaaagaaagaaagaaagaaagaaagaaagaaagaaagaaagaaagaaagaaagaaag

SEQ ID NO: 1909 - DNA, 76 bp, Homo sapiens; identical to SEQ ID NO: 1873

SEQ ID NO: 1910 - DNA, 72 bp, Homo sapiens; identical to SEQ ID NO: 1872

SEQ ID NO: 1911 - DNA, 72 bp, Homo sapiens; identical to SEQ ID NO: 1872

SEQ ID NO: 1912 - DNA, 68 bp, Homo sapiens; identical to SEQ ID NO: 1871

SEQ ID NO: 1913 - DNA, 72 bp, Homo sapiens; identical to SEQ ID NO: 1872

SEQ ID NO: 1914 - DNA, 76 bp, Homo sapiens; identical to SEQ ID NO: 1873

SEQ ID NO: 1915 - DNA, 72 bp, Homo sapiens; identical to SEQ ID NO: 1872

SEQ ID NO: 1916 - DNA, 76 bp, Homo sapiens; identical to SEQ ID NO: 1873

SEQ ID NO: 1917 - DNA, 80 bp, Homo sapiens; identical to SEQ ID NO: 1883

SEQ ID NO: 1918 - DNA, 76 bp, Homo sapiens; identical to SEQ ID NO: 1873

SEQ ID NO: 1919 - DNA, 32 bp, Homo sapiens
aaataaataaataaataaataaataaataaat

SEQ ID NO: 1920 - DNA, 36 bp, Homo sapiens; identical to SEQ ID NO: 954

SEQ ID NO: 1921 - DNA, 45 bp, Homo sapiens
ttatgttatgttatgttatgttatgttatgttatgttatgttatg

SEQ ID NO: 1922 - DNA, 50 bp, Homo sapiens
ttatgttatgttatgttatgttatgttatgttatgttatgttatgttatg

SEQ ID NO: 1923 - DNA, 45 bp, Homo sapiens; identical to SEQ ID NO: 1921

SEQ ID NO: 1924 - DNA, 40 bp, Homo sapiens
ttatgttatgttatgttatgttatgttatgttatgttatg

SEQ ID NO: 1925 - DNA, 45 bp, Homo sapiens; identical to SEQ ID NO: 1921

SEQ ID NO: 1926 - DNA, 50 bp, Homo sapiens; identical to SEQ ID NO: 1922

SEQ ID NO: 1927 - DNA, 85 bp, Homo sapiens
caatacaatacaatacaatacaatacaatacaatacaatacaatacaatacaatacagtacaatacagtacaatacagtacaata

SEQ ID NO: 1928 - DNA, 80 bp, Homo sapiens
caatacaatacaatacaatacaatacaatacaatacaatacaatacaatacagtacaatacagtacaatacagtacaata

SEQ ID NO: 1929 - DNA, 85 bp, Homo sapiens; identical to SEQ ID NO: 1927

SEQ ID NO: 1930 - DNA, 90 bp, Homo sapiens
caatacaatacaatacaatacaatacaatacaatacaatacaatacaatacaatacaatacagtacaatacagtacaatacagtacaata

SEQ ID NO: 1931 - DNA, 90 bp, Homo sapiens; identical to SEQ ID NO: 1930

SEQ ID NO: 1932 - DNA, 85 bp, Homo sapiens; identical to SEQ ID NO: 1927

SEQ ID NO: 1933 - DNA, 90 bp, Homo sapiens; identical to SEQ ID NO: 1930

SEQ ID NO: 1934 - DNA, 95 bp, Homo sapiens
caatacaatacaatacaatacaatacaatacaatacaatacaatacaatacaatacaatacaatacagtacaatacagtacaatacagtacaata

SEQ ID NO: 1935 - DNA, 60 bp, Homo sapiens
aaaacaaaacaaaacaaaacaaaataaaataaaataaaataaaataaaataaaataaaat

SEQ ID NO: 1936 - DNA, 55 bp, Homo sapiens
aaaacaaaacaaaacaaaacaaaataaaataaaataaaataaaataaaataaaat

SEQ ID NO: 1937 - DNA, 60 bp, Homo sapiens; identical to SEQ ID NO: 1935

SEQ ID NO: 1938 - DNA, 65 bp, Homo sapiens
aaaacaaaacaaaacaaaacaaaataaaataaaataaaataaaataaaataaaataaaataaaat

SEQ ID NO: 1939 - DNA, 50 bp, Homo sapiens
aaataaaataaaataaaataaaataaaataaaataaaataaaataaaata

SEQ ID NO: 1940 - DNA, 55 bp, Homo sapiens
aaataaaataaaataaaataaaataaaataaaataaaataaaataaaataaaata

SEQ ID NO: 1941 - DNA, 342 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (274)..(296): a, c, t, g, unknown or other
  modified_base (309)..(312): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1942 - DNA, 345 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (277)..(299): a, c, t, g, unknown or other
  modified_base (312)..(315): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1943 - DNA, 336 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (268)..(290): a, c, t, g, unknown or other
  modified_base (303)..(306): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1944 - DNA, 333 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1945 - DNA, 339 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (271)..(293): a, c, t, g, unknown or other
  modified_base (306)..(309): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1946 - DNA, 333 bp, Homo sapiens; identical to SEQ ID NO: 1944
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other

SEQ ID NO: 1947 - DNA, 330 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (262)..(284): a, c, t, g, unknown or other
  modified_base (297)..(300): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1948 - DNA, 327 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (259)..(281): a, c, t, g, unknown or other
  modified_base (294)..(297): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnttcttcttcttcctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1949 - DNA, 336 bp, Homo sapiens; identical to SEQ ID NO: 1943
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (268)..(290): a, c, t, g, unknown or other
  modified_base (303)..(306): a, c, t, g, unknown or other

SEQ ID NO: 1950 - DNA, 339 bp, Homo sapiens; identical to SEQ ID NO: 1945
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (271)..(293): a, c, t, g, unknown or other
  modified_base (306)..(309): a, c, t, g, unknown or other

SEQ ID NO: 1951 - DNA, 333 bp, Homo sapiens; identical to SEQ ID NO: 1944
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other

SEQ ID NO: 1952 - DNA, 330 bp, Homo sapiens; identical to SEQ ID NO: 1947
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (262)..(284): a, c, t, g, unknown or other
  modified_base (297)..(300): a, c, t, g, unknown or other

SEQ ID NO: 1953 - DNA, 333 bp, Homo sapiens; identical to SEQ ID NO: 1944
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other

SEQ ID NO: 1954 - DNA, 318 bp, Homo sapiens
  modified_base (16)..(24): a, c, t, g, unknown or other
  modified_base (49)..(57): a, c, t, g, unknown or other
  modified_base (85)..(99): a, c, t, g, unknown or other
  modified_base (123)..(142): a, c, t, g, unknown or other
  modified_base (165)..(171): a, c, t, g, unknown or other
  modified_base (181)..(189): a, c, t, g, unknown or other
  modified_base (250)..(272): a, c, t, g, unknown or other
  modified_base (285)..(288): a, c, t, g, unknown or other
ttcttcttcttcttcnnnnnnnnnttcttcttcttcctcttcttcttcnnnnnnnnnttcttcttcttcttcctcttcttcttcnnnnnnnnnnnnnnnctttcttcttcctcttcttcttcnnnnnnnnnnnnnnnnnnnnttcttcttctttcttcttcttcnnnnnnnttcttcttcnnnnnnnnnttcttcttcttctccttcttcttcttcttcttcttcttcttcttcttcttcttcttcttcnnnnnnnnnnnnnnnnnnnnnnnttcttcttcttcnnnnttcctcttcctcctcttcctcttcctcttc

SEQ ID NO: 1955 - DNA, 333 bp, Homo sapiens; identical to SEQ ID NO: 1944
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other

SEQ ID NO: 1956 - DNA, 330 bp, Homo sapiens; identical to SEQ ID NO: 1947
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (262)..(284): a, c, t, g, unknown or other
  modified_base (297)..(300): a, c, t, g, unknown or other

SEQ ID NO: 1957 - DNA, 333 bp, Homo sapiens; identical to SEQ ID NO: 1944
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other

SEQ ID NO: 1958 - DNA, 327 bp, Homo sapiens; identical to SEQ ID NO: 1948
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (259)..(281): a, c, t, g, unknown or other
  modified_base (294)..(297): a, c, t, g, unknown or other

SEQ ID NO: 1959 - DNA, 336 bp, Homo sapiens; identical to SEQ ID NO: 1943
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (268)..(290): a, c, t, g, unknown or other
  modified_base (303)..(306): a, c, t, g, unknown or other

SEQ ID NO: 1960 - DNA, 333 bp, Homo sapiens; identical to SEQ ID NO: 1944
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (265)..(287): a, c, t, g, unknown or other
  modified_base (300)..(303): a, c, t, g, unknown or other

SEQ ID NO: 1961 - DNA, 330 bp, Homo sapiens; identical to SEQ ID NO: 1947
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (262)..(284): a, c, t, g, unknown or other
  modified_base (297)..(300): a, c, t, g, unknown or other

SEQ ID NO: 1962 - DNA, 327 bp, Homo sapiens; identical to SEQ ID NO: 1948
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (259)..(281): a, c, t, g, unknown or other
  modified_base (294)..(297): a, c, t, g, unknown or other

SEQ ID NO: 1963 - DNA, 342 bp, Homo sapiens; identical to SEQ ID NO: 1941
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (274)..(296): a, c, t, g, unknown or other
  modified_base (309)..(312): a, c, t, g, unknown or other

SEQ ID NO: 1964 - DNA, 339 bp, Homo sapiens; identical to SEQ ID NO: 1945
  modified_base (16)..(24): a, c, t, g, unknown or other
  modified_base (49)..(57): a, c, t, g, unknown or other
  modified_base (85)..(99): a, c, t, g, unknown or other
  modified_base (135)..(154): a, c, t, g, unknown or other
  modified_base (177)..(183): a, c, t, g, unknown or other
  modified_base (193)..(201): a, c, t, g, unknown or other
  modified_base (271)..(293): a, c, t, g, unknown or other
  modified_base (306)..(309): a, c, t, g, unknown or other

SEQ ID NO: 1965 - DNA, 114 bp, Homo sapiens
cctcctcctcctcctctttcttcttcttctccttcttcttcttcttcttcttcttcttcttcttcttcttcttcttcttcttcttcttcttcttcttcttcttcttcttcttct

SEQ ID NO: 1966 - DNA, 111 bp, Homo sapiens
cctcctcctcctcctctttcttcttcttctccttcttcttcttcttcttcttcttcttcttcttcttcttcttcttcttcttcttcttcttcttcttcttcttcttcttct

SEQ ID NO: 1967 - DNA, 108 bp, Homo sapiens
cctcctcctcctcctctttcttcttcttctccttcttcttcttcttcttcttcttcttcttcttcttcttcttcttcttcttcttcttcttcttcttcttcttcttct

SEQ ID NO: 1968 - DNA, 111 bp, Homo sapiens; identical to SEQ ID NO: 1966

SEQ ID NO: 1969 - DNA, 111 bp, Homo sapiens; identical to SEQ ID NO: 1966

SEQ ID NO: 1970 - DNA, 108 bp, Homo sapiens; identical to SEQ ID NO: 1967

SEQ ID NO: 1971 - DNA, 114 bp, Homo sapiens; identical to SEQ ID NO: 1965

SEQ ID NO: 1972 - DNA, 117 bp, Homo sapiens
cctcctcctcctcctctttcttcttcttctccttcttcttcttcttcttcttcttcttcttcttcttcttcttcttcttcttcttcttcttcttcttcttcttcttcttcttcttct

SEQ ID NO: 1973 - DNA, 108 bp, Homo sapiens; identical to SEQ ID NO: 1967

SEQ ID NO: 1974 - DNA, 105 bp, Homo sapiens
cctcctcctcctcctctttcttcttcttctccttcttcttcttcttcttcttcttcttcttcttcttcttcttcttcttcttcttcttcttcttcttcttcttct

SEQ ID NO: 1975 - DNA, 108 bp, Homo sapiens; identical to SEQ ID NO: 1967

SEQ ID NO: 1976 - DNA, 105 bp, Homo sapiens; identical to SEQ ID NO: 1974

SEQ ID NO: 1977 - DNA, 111 bp, Homo sapiens; identical to SEQ ID NO: 1966

SEQ ID NO: 1978 - DNA, 114 bp, Homo sapiens; identical to SEQ ID NO: 1965

SEQ ID NO: 1979 - DNA, 108 bp, Homo sapiens; identical to SEQ ID NO: 1967

SEQ ID NO: 1980 - DNA, 105 bp, Homo sapiens; identical to SEQ ID NO: 1974

SEQ ID NO: 1981 - DNA, 108 bp, Homo sapiens; identical to SEQ ID NO: 1967

SEQ ID NO: 1982 - DNA, 105 bp, Homo sapiens; identical to SEQ ID NO: 1974

SEQ ID NO: 1983 - DNA, 105 bp, Homo sapiens; identical to SEQ ID NO: 1974

SEQ ID NO: 1984 - DNA, 108 bp, Homo sapiens; identical to SEQ ID NO: 1967

SEQ ID NO: 1985 - DNA, 108 bp, Homo sapiens; identical to SEQ ID NO: 1967

SEQ ID NO: 1986 - DNA, 111 bp, Homo sapiens; identical to SEQ ID NO: 1966

SEQ ID NO: 1987 - DNA, 99 bp, Homo sapiens
cctcctcctcctcctctttcttcttcttctccttcttcttcttcttcttcttcttcttcttcttcttcttcttcttcttcttcttcttcttcttcttct

SEQ ID NO: 1988 - DNA, 96 bp, Homo sapiens
cctcctcctcctcctctttcttcttcttctccttcttcttcttcttcttcttcttcttcttcttcttcttcttcttcttcttcttcttcttcttct

SEQ ID NO: 1989 - DNA, 108 bp, Homo sapiens; identical to SEQ ID NO: 1967

SEQ ID NO: 1990 - DNA, 111 bp, Homo sapiens; identical to SEQ ID NO: 1966

SEQ ID NO: 1991 - DNA, 111 bp, Homo sapiens; identical to SEQ ID NO: 1966

SEQ ID NO: 1992 - DNA, 114 bp, Homo sapiens; identical to SEQ ID NO: 1965

SEQ ID NO: 1993 - DNA, 105 bp, Homo sapiens; identical to SEQ ID NO: 1974

SEQ ID NO: 1994 - DNA, 108 bp, Homo sapiens; identical to SEQ ID NO: 1967

SEQ ID NO: 1995 - DNA, 117 bp, Homo sapiens; identical to SEQ ID NO: 1972

SEQ ID NO: 1996 - DNA, 114 bp, Homo sapiens; identical to SEQ ID NO: 1965

SEQ ID NO: 1997 - DNA, 108 bp, Homo sapiens; identical to SEQ ID NO: 1967

SEQ ID NO: 1998 - DNA, 105 bp, Homo sapiens; identical to SEQ ID NO: 1974

SEQ ID NO: 1999 - DNA, 114 bp, Homo sapiens; identical to SEQ ID NO: 1965

SEQ ID NO: 2000 - DNA, 111 bp, Homo sapiens; identical to SEQ ID NO: 1966

SEQ ID NO: 2001 - DNA, 111 bp, Homo sapiens; identical to SEQ ID NO: 1966

SEQ ID NO: 2002 - DNA, 108 bp, Homo sapiens; identical to SEQ ID NO: 1967

SEQ ID NO: 2003 - DNA, 108 bp, Homo sapiens; identical to SEQ ID NO: 1967

SEQ ID NO: 2004 - DNA, 105 bp, Homo sapiens; identical to SEQ ID NO: 1974

SEQ ID NO: 2005 - DNA, 102 bp, Homo sapiens
cctcctcctcctcctctttcttcttcttctccttcttcttcttcttcttcttcttcttcttcttcttcttcttcttcttcttcttcttcttcttcttcttct

SEQ ID NO: 2006 - DNA, 105 bp, Homo sapiens; identical to SEQ ID NO: 1974

SEQ ID NO: 2007 - DNA, 102 bp, Homo sapiens; identical to SEQ ID NO: 2005

SEQ ID NO: 2008 - DNA, 105 bp, Homo sapiens; identical to SEQ ID NO: 1974

SEQ ID NO: 2009 - DNA, 114 bp, Homo sapiens; identical to SEQ ID NO: 1965

SEQ ID NO: 2010 - DNA, 111 bp, Homo sapiens; identical to SEQ ID NO: 1966

SEQ ID NO: 2011 - DNA, 117 bp, Homo sapiens; identical to SEQ ID NO: 1972

SEQ ID NO: 2012 - DNA, 114 bp, Homo sapiens; identical to SEQ ID NO: 1965

SEQ ID NO: 2013 - DNA, 108 bp, Homo sapiens; identical to SEQ ID NO: 1967

SEQ ID NO: 2014 - DNA, 111 bp, Homo sapiens; identical to SEQ ID NO: 1966

SEQ ID NO: 2015 - DNA, 273 bp, Homo sapiens
  modified_base (25)..(39): a, c, t, g, unknown or other
  modified_base (76)..(93): a, c, t, g, unknown or other
  modified_base (118)..(137): a, c, t, g, unknown or other
  modified_base (215)..(222): a, c, t, g, unknown or other
cttcttcttcttcctcttcttcttnnnnnnnnnnnnnnncctcctcctcctcttcttcttcttcctcttcttcttnnnnnnnnnnnnnnnnnncctcctcctcttcttcttcttcttnnnnnnnnnnnnnnnnnnnncttctgcttctgcttctgctcttcttcttcttcttcttcttcttcttcttcttcttcttcttcttcttcttcttcttnnnnnnnncttcttcttcttctccttctccttctccttctctttcttcttcttcttctt

SEQ ID NO: 2016 - DNA, 270 bp, Homo sapiens
  modified_base (25)..(39): a, c, t, g, unknown or other
  modified_base (76)..(93): a, c, t, g, unknown or other
  modified_base (118)..(137): a, c, t, g, unknown or other
  modified_base (212)..(219): a, c, t, g, unknown or other
cttcttcttcttcctcttcttcttnnnnnnnnnnnnnnncctcctcctcctcttcttcttcttcctcttcttcttnnnnnnnnnnnnnnnnnncctcctcctcttcttcttcttcttnnnnnnnnnnnnnnnnnnnncttctgcttctgcttctgctcttcttcttcttcttcttcttcttcttcttcttcttcttcttcttcttcttcttnnnnnnnncttcttcttcttctccttctccttctccttctctttcttcttcttcttctt

SEQ ID NO: 2017 - DNA, 276 bp, Homo sapiens
  modified_base (25)..(39): a, c, t, g, unknown or other
  modified_base (76)..(93): a, c, t, g, unknown or other
  modified_base (118)..(137): a, c, t, g, unknown or other
  modified_base (218)..(225): a, c, t, g, unknown or other
cttcttcttcttcctcttcttcttnnnnnnnnnnnnnnncctcctcctcctcttcttcttcttcctcttcttcttnnnnnnnnnnnnnnnnnncctcctcctcttcttcttcttcttnnnnnnnnnnnnnnnnnnnncttctgcttctgcttctgctcttcttcttcttcttcttcttcttcttcttcttcttcttcttcttcttcttcttcttcttnnnnnnnncttcttcttcttctccttctccttctccttctctttcttcttcttcttctt

SEQ ID NO: 2018 - DNA, 273 bp, Homo sapiens; identical to SEQ ID NO: 2015
  modified_base (25)..(39): a, c, t, g, unknown or other
  modified_base (76)..(93): a, c, t, g, unknown or other
  modified_base (118)..(137): a, c, t, g, unknown or other
  modified_base (215)..(222): a, c, t, g, unknown or other

SEQ ID NO: 2019 - DNA, 270 bp, Homo sapiens; identical to SEQ ID NO: 2016
  modified_base (25)..(39): a, c, t, g, unknown or other
  modified_base (76)..(93): a, c, t, g, unknown or other
  modified_base (118)..(137): a, c, t, g, unknown or other
  modified_base (212)..(219): a, c, t, g, unknown or other

SEQ ID NO: 2020 - DNA, 267 bp, Homo sapiens
  modified_base (25)..(39): a, c, t, g, unknown or other
  modified_base (76)..(93): a, c, t, g, unknown or other
  modified_base (118)..(137): a, c, t, g, unknown or other
  modified_base (209)..(216): a, c, t, g, unknown or other
cttcttcttcttcctcttcttcttnnnnnnnnnnnnnnncctcctcctcctcttcttcttcttcctcttcttcttnnnnnnnnnnnnnnnnnncctcctcctcttcttcttcttcttnnnnnnnnnnnnnnnnnnnncttctgcttctgcttctgctcttcttcttcttcttcttcttcttcttcttcttcttcttcttcttcttcttnnnnnnnncttcttcttcttctccttctccttctccttctctttcttcttcttcttctt

SEQ ID NO: 2021 - DNA, 270 bp, Homo sapiens; identical to SEQ ID NO: 2016
  modified_base (25)..(39): a, c, t, g, unknown or other
  modified_base (76)..(93): a, c, t, g, unknown or other
  modified_base (118)..(137): a, c, t, g, unknown or other
  modified_base (212)..(219): a, c, t, g, unknown or other

SEQ ID NO: 2022 - DNA, 273 bp, Homo sapiens; identical to SEQ ID NO: 2015
  modified_base (25)..(39): a, c, t, g, unknown or other
  modified_base (76)..(93): a, c, t, g, unknown or other
  modified_base (118)..(137): a, c, t, g, unknown or other
  modified_base (215)..(222): a, c, t, g, unknown or other

SEQ ID NO: 2023 - DNA, 270 bp, Homo sapiens; identical to SEQ ID NO: 2016
  modified_base (25)..(39): a, c, t, g, unknown or other
  modified_base (76)..(93): a, c, t, g, unknown or other
  modified_base (118)..(137): a, c, t, g, unknown or other
  modified_base (212)..(219): a, c, t, g, unknown or other

SEQ ID NO: 2024 - DNA, 273 bp, Homo sapiens; identical to SEQ ID NO: 2015
  modified_base (25)..(39): a, c, t, g, unknown or other
  modified_base (76)..(93): a, c, t, g, unknown or other
  modified_base (118)..(137): a, c, t, g, unknown or other
  modified_base (215)..(222): a, c, t, g, unknown or other

SEQ ID NO: 2025 - DNA, 273 bp, Homo sapiens; identical to SEQ ID NO: 2015
  modified_base (25)..(39): a, c, t, g, unknown or other
  modified_base (76)..(93): a, c, t, g, unknown or other
  modified_base (118)..(137): a, c, t, g, unknown or other
  modified_base (215)..(222): a, c, t, g, unknown or other

SEQ ID NO: 2026 - DNA, 270 bp, Homo sapiens; identical to SEQ ID NO: 2016
  modified_base (25)..(39): a, c, t, g, unknown or other
  modified_base (76)..(93): a, c, t, g, unknown or other
  modified_base (118)..(137): a, c, t, g, unknown or other
  modified_base (212)..(219): a, c, t, g, unknown or other

SEQ ID NO: 2027 - DNA, 270 bp, Homo sapiens; identical to SEQ ID NO: 2016
  modified_base (25)..(39): a, c, t, g, unknown or other
  modified_base (76)..(93): a, c, t, g, unknown or other
  modified_base (118)..(137): a, c, t, g, unknown or other
  modified_base (212)..(219): a, c, t, g, unknown or other

SEQ ID NO: 2028 - DNA, 264 bp, Homo sapiens
  modified_base (25)..(39): a, c, t, g, unknown or other
  modified_base (76)..(93): a, c, t, g, unknown or other
  modified_base (118)..(137): a, c, t, g, unknown or other
  modified_base (206)..(213): a, c, t, g, unknown or other
cttcttcttcttcctcttcttcttnnnnnnnnnnnnnnncctcctcctcctcttcttcttcttcctcttcttcttnnnnnnnnnnnnnnnnnncctcctcctcttcttcttcttcttnnnnnnnnnnnnnnnnnnnncttctgcttctgcttctgctcttcttcttcttcttcttcttcttcttcttcttcttcttcttcttcttnnnnnnnncttcttcttcttctccttctccttctccttctctttcttcttcttcttctt

SEQ ID NO: 2029 - DNA, 54 bp, Homo sapiens
tattattattattattattattattattattattattattatcattattattat

SEQ ID NO: 2030 - DNA, 57 bp, Homo sapiens
tattattattattattattattattattattattattattattatcattattattat

SEQ ID NO: 2031 - DNA, 57 bp, Homo sapiens; identical to SEQ ID NO: 2030

SEQ ID NO: 2032 - DNA, 54 bp, Homo sapiens; identical to SEQ ID NO: 2029

SEQ ID NO: 2033 - DNA, 77 bp, Homo sapiens
gaaagaaagaaagaaagaaagaaaagaaggaaagaaagaaagaaagaaagaaagaaagaaagaaagaaagaaagaaa

SEQ ID NO: 2034 - DNA, 81 bp, Homo sapiens
gaaagaaagaaagaaagaaagaaaagaaggaaagaaagaaagaaagaaagaaagaaagaaagaaagaaagaaagaaagaaa

SEQ ID NO: 2035 - DNA, 85 bp, Homo sapiens
gaaagaaagaaagaaagaaagaaaagaaggaaagaaagaaagaaagaaagaaagaaagaaagaaagaaagaaagaaagaaagaaa

SEQ ID NO: 2036 - DNA, 89 bp, Homo sapiens
gaaagaaagaaagaaagaaagaaaagaaggaaagaaagaaagaaagaaagaaagaaagaaagaaagaaagaaagaaagaaagaaagaaa

SEQ ID NO: 2037 - DNA, 85 bp, Homo sapiens; identical to SEQ ID NO: 2035

SEQ ID NO: 2038 - DNA, 81 bp, Homo sapiens; identical to SEQ ID NO: 2034

SEQ ID NO: 2039 - DNA, 73 bp, Homo sapiens
gaaagaaagaaagaaagaaagaaaagaaggaaagaaagaaagaaagaaagaaagaaagaaagaaagaaagaaa

SEQ ID NO: 2040 - DNA, 69 bp, Homo sapiens
gaaagaaagaaagaaagaaagaaaagaaggaaagaaagaaagaaagaaagaaagaaagaaagaaagaaa

SEQ ID NO: 2041 - DNA, 81 bp, Homo sapiens; identical to SEQ ID NO: 2034

SEQ ID NO: 2042 - DNA, 77 bp, Homo sapiens; identical to SEQ ID NO: 2033

SEQ ID NO: 2043 - DNA, 184 bp, Homo sapiens
  modified_base (66)..(112): a, c, t, g, unknown or other
  modified_base (163)..(172): a, c, t, g, unknown or other
ctttctttctttctttttctctttctttcttttttctttctttctttctttttctttctttctttnnnnnnnnnnnnnnnnnnnnnnnnnnnnnnnnnnnnnnnnnnnnnnnctttctttctttctttctctttctttctttctttccttctttctttctttnnnnnnnnnnctttctttcttt

SEQ ID NO: 2044 - DNA, 180 bp, Homo sapiens
  modified_base (66)..(112): a, c, t, g, unknown or other
  modified_base (159)..(168): a, c, t, g, unknown or other
ctttctttctttctttttctctttctttcttttttctttctttctttctttttctttctttctttnnnnnnnnnnnnnnnnnnnnnnnnnnnnnnnnnnnnnnnnnnnnnnnctttctttctttctctttctttctttctttccttctttctttctttnnnnnnnnnnctttctttcttt

SEQ ID NO: 2045 - DNA, 165 bp, Homo sapiens
  modified_base (77)..(100): a, c, t, g, unknown or other
  modified_base (113)..(118): a, c, t, g, unknown or other
gaaagaaagaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2046 - DNA, 169 bp, Homo sapiens
  modified_base (81)..(104): a, c, t, g, unknown or other
  modified_base (117)..(122): a, c, t, g, unknown or other
gaaagaaagaaagaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2047 - DNA, 153 bp, Homo sapiens
  modified_base (65)..(88): a, c, t, g, unknown or other
  modified_base (101)..(106): a, c, t, g, unknown or other
gaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2048 - DNA, 157 bp, Homo sapiens
  modified_base (69)..(92): a, c, t, g, unknown or other
  modified_base (105)..(110): a, c, t, g, unknown or other
gaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2049 - DNA, 157 bp, Homo sapiens; identical to SEQ ID NO: 2048
  modified_base (69)..(92): a, c, t, g, unknown or other
  modified_base (105)..(110): a, c, t, g, unknown or other

SEQ ID NO: 2050 - DNA, 161 bp, Homo sapiens
  modified_base (73)..(96): a, c, t, g, unknown or other
  modified_base (109)..(114): a, c, t, g, unknown or other
gaaagaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2051 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2052 - DNA, 157 bp, Homo sapiens; identical to SEQ ID NO: 2048
  modified_base (69)..(92): a, c, t, g, unknown or other
  modified_base (105)..(110): a, c, t, g, unknown or other

SEQ ID NO: 2053 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2054 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2055 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2056 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2057 - DNA, 157 bp, Homo sapiens; identical to SEQ ID NO: 2048
  modified_base (69)..(92): a, c, t, g, unknown or other
  modified_base (105)..(110): a, c, t, g, unknown or other

SEQ ID NO: 2058 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2059 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2060 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2061 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2062 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2063 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2064 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2065 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2066 - DNA, 173 bp, Homo sapiens
  modified_base (85)..(108): a, c, t, g, unknown or other
  modified_base (121)..(126): a, c, t, g, unknown or other
gaaagaaagaaagaaagaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2067 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2068 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2069 - DNA, 157 bp, Homo sapiens; identical to SEQ ID NO: 2048
  modified_base (69)..(92): a, c, t, g, unknown or other
  modified_base (105)..(110): a, c, t, g, unknown or other

SEQ ID NO: 2070 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2071 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2072 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2073 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2074 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2075 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2076 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2077 - DNA, 153 bp, Homo sapiens; identical to SEQ ID NO: 2047
  modified_base (65)..(88): a, c, t, g, unknown or other
  modified_base (101)..(106): a, c, t, g, unknown or other

SEQ ID NO: 2078 - DNA, 149 bp, Homo sapiens
  modified_base (61)..(84): a, c, t, g, unknown or other
  modified_base (97)..(102): a, c, t, g, unknown or other
gaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2079 - DNA, 161 bp, Homo sapiens; identical to SEQ ID NO: 2050
  modified_base (73)..(96): a, c, t, g, unknown or other
  modified_base (109)..(114): a, c, t, g, unknown or other

SEQ ID NO: 2080 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2081 - DNA, 165 bp, Homo sapiens; identical to SEQ ID NO: 2045
  modified_base (77)..(100): a, c, t, g, unknown or other
  modified_base (113)..(118): a, c, t, g, unknown or other

SEQ ID NO: 2082 - DNA, 169 bp, Homo sapiens; identical to SEQ ID NO: 2046
  modified_base (81)..(104): a, c, t, g, unknown or other
  modified_base (117)..(122): a, c, t, g, unknown or other

SEQ ID NO: 2083 - DNA, 177 bp, Homo sapiens
  modified_base (89)..(112): a, c, t, g, unknown or other
  modified_base (125)..(130): a, c, t, g, unknown or other
gaaagaaagaaagaaagaaagaaagaaagaaagaaagaaagaaagaaagaaagaaagaaagaaagaaagaaagaaagaaagaaagaaannnnnnnnnnnnnnnnnnnnnnnngaaagaaagaaannnnnngaaagaaagaaagaaagaaaaaagaaagaaagaaggaaagaaagaaa

SEQ ID NO: 2084 - DNA, 173 bp, Homo sapiens; identical to SEQ ID NO: 2066
  modified_base (85)..(108): a, c, t, g, unknown or other
  modified_base (121)..(126): a, c, t, g, unknown or other

SEQ ID NO: 2085 - DNA, 217 bp, Homo sapiens
  modified_base (13)..(28): a, c, t, g, unknown or other
  modified_base (125)..(205): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2086 - DNA, 213 bp, Homo sapiens
  modified_base (13)..(28): a, c, t, g, unknown or other
  modified_base (121)..(201): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2087 - DNA, 221 bp, Homo sapiens
  modified_base (13)..(28): a, c, t, g, unknown or other
  modified_base (129)..(209): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2088 - DNA, 217 bp, Homo sapiens; identical to SEQ ID NO: 2085
  modified_base (13)..(28): a, c, t, g, unknown or other
  modified_base (125)..(205): a, c, t, g, unknown or other

SEQ ID NO: 2089 - DNA, 205 bp, Homo sapiens
  modified_base (13)..(28): a, c, t, g, unknown or other
  modified_base (113)..(193): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2090 - DNA, 209 bp, Homo sapiens
  modified_base (13)..(28): a, c, t, g, unknown or other
  modified_base (117)..(197): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2091 - DNA, 205 bp, Homo sapiens; identical to SEQ ID NO: 2089
  modified_base (13)..(28): a, c, t, g, unknown or other
  modified_base (113)..(193): a, c, t, g, unknown or other

SEQ ID NO: 2092 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2093 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2094 - DNA, 205 bp, Homo sapiens; identical to SEQ ID NO: 2089
  modified_base (13)..(28): a, c, t, g, unknown or other
  modified_base (113)..(193): a, c, t, g, unknown or other

SEQ ID NO: 2095 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2096 - DNA, 217 bp, Homo sapiens; identical to SEQ ID NO: 2085
  modified_base (13)..(28): a, c, t, g, unknown or other
  modified_base (125)..(205): a, c, t, g, unknown or other

SEQ ID NO: 2097 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2098 - DNA, 205 bp, Homo sapiens; identical to SEQ ID NO: 2089
  modified_base (13)..(28): a, c, t, g, unknown or other
  modified_base (113)..(193): a, c, t, g, unknown or other

SEQ ID NO: 2099 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2100 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2101 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2102 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2103 - DNA, 205 bp, Homo sapiens; identical to SEQ ID NO: 2089
  modified_base (13)..(28): a, c, t, g, unknown or other
  modified_base (113)..(193): a, c, t, g, unknown or other

SEQ ID NO: 2104 - DNA, 201 bp, Homo sapiens
  modified_base (13)..(28): a, c, t, g, unknown or other
  modified_base (109)..(189): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2105 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2106 - DNA, 217 bp, Homo sapiens; identical to SEQ ID NO: 2085
  modified_base (13)..(28): a, c, t, g, unknown or other
  modified_base (125)..(205): a, c, t, g, unknown or other

SEQ ID NO: 2107 - DNA, 225 bp, Homo sapiens
  modified_base (13)..(28): a, c, t, g, unknown or other
  modified_base (133)..(213): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2108 - DNA, 221 bp, Homo sapiens; identical to SEQ ID NO: 2087
  modified_base (13)..(28): a, c, t, g, unknown or other
  modified_base (129)..(209): a, c, t, g, unknown or other

SEQ ID NO: 2109 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2110 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2111 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2112 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2113 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2114 - DNA, 205 bp, Homo sapiens; identical to SEQ ID NO: 2089
  modified_base (13)..(28): a, c, t, g, unknown or other
  modified_base (113)..(193): a, c, t, g, unknown or other

SEQ ID NO: 2115 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2116 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2117 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2118 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2119 - DNA, 193 bp, Homo sapiens
  modified_base (13)..(28): a, c, t, g, unknown or other
  modified_base (101)..(181): a, c, t, g, unknown or other
agaaagaaagaannnnnnnnnnnnnnnnagagagagagagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2120 - DNA, 197 bp, Homo sapiens
  modified_base (13)..(28): a, c, t, g, unknown or other
  modified_base (105)..(185): a, c, t, g, unknown or other
agaaagaaagaannnnnnnnnnnnnnnnagagagagagagaaagaaagaaagaaagaaagaaagaaagaaagaaagaaagaaagaaagaaagaaagaaagaaagnnnnnnnnnnnnnnnnnnnnnnnnnnnnnnnnnnnnnnnnnnnnnnnnnnnnnnnnnnnnnnnnnnnnnnnnnnnnnnnnnaaggaaggaagg

SEQ ID NO: 2121 - DNA, 205 bp, Homo sapiens; identical to SEQ ID NO: 2089
  modified_base (13)..(28): a, c, t, g, unknown or other
  modified_base (113)..(193): a, c, t, g, unknown or other

SEQ ID NO: 2122 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2123 - DNA, 221 bp, Homo sapiens; identical to SEQ ID NO: 2087
  modified_base (13)..(28): a, c, t, g, unknown or other
  modified_base (129)..(209): a, c, t, g, unknown or other

SEQ ID NO: 2124 - DNA, 225 bp, Homo sapiens; identical to SEQ ID NO: 2107
  modified_base (13)..(28): a, c, t, g, unknown or other
  modified_base (133)..(213): a, c, t, g, unknown or other

SEQ ID NO: 2125 - DNA, 209 bp, Homo sapiens; identical to SEQ ID NO: 2090
  modified_base (13)..(28): a, c, t, g, unknown or other
  modified_base (117)..(197): a, c, t, g, unknown or other

SEQ ID NO: 2126 - DNA, 213 bp, Homo sapiens; identical to SEQ ID NO: 2086
  modified_base (13)..(28): a, c, t, g, unknown or other
  modified_base (121)..(201): a, c, t, g, unknown or other

SEQ ID NO: 2127 - DNA, 36 bp, Homo sapiens
tatctatctatctatctatctatctatctatctatc

SEQ ID NO: 2128 - DNA, 40 bp, Homo sapiens; identical to SEQ ID NO: 945

SEQ ID NO: 2129 - DNA, 102 bp, Homo sapiens
  modified_base (29)..(46): a, c, t, g, unknown or other
aaagaaagaaagaaagagagagagagagnnnnnnnnnnnnnnnnnnaaagaaagaaagaaagaaagaaagaaagaaagaaagaaagaaagaaagaaagaaag

SEQ ID NO: 2130 - DNA, 106 bp, Homo sapiens
  modified_base (29)..(46): a, c, t, g, unknown or other
aaagaaagaaagaaagagagagagagagnnnnnnnnnnnnnnnnnnaaagaaagaaagaaagaaagaaagaaagaaagaaagaaagaaagaaagaaagaaagaaag

SEQ ID NO: 2131 - DNA, 106 bp, Homo sapiens; identical to SEQ ID NO: 2130
  modified_base (29)..(46): a, c, t, g, unknown or other

SEQ ID NO: 2132 - DNA, 102 bp, Homo sapiens; identical to SEQ ID NO: 2129
  modified_base (29)..(46): a, c, t, g, unknown or other

SEQ ID NO: 2133 - DNA, 118 bp, Homo sapiens
  modified_base (29)..(46): a, c, t, g, unknown or other
aaagaaagaaagaaagagagagagagagnnnnnnnnnnnnnnnnnnaaagaaagaaagaaagaaagaaagaaagaaagaaagaaagaaagaaagaaagaaagaaagaaagaaagaaag

SEQ ID NO: 2134 - DNA, 114 bp, Homo sapiens
  modified_base (29)..(46): a, c, t, g, unknown or other
aaagaaagaaagaaagagagagagagagnnnnnnnnnnnnnnnnnnaaagaaagaaagaaagaaagaaagaaagaaagaaagaaagaaagaaagaaagaaagaaagaaagaaag

SEQ ID NO: 2135 - DNA, 110 bp, Homo sapiens
  modified_base (29)..(46): a, c, t, g, unknown or other
aaagaaagaaagaaagagagagagagagnnnnnnnnnnnnnnnnnnaaagaaagaaagaaagaaagaaagaaagaaagaaagaaagaaagaaagaaagaaagaaagaaag

SEQ ID NO: 2136 - DNA, 106 bp, Homo sapiens; identical to SEQ ID NO: 2130
  modified_base (29)..(46): a, c, t, g, unknown or other

SEQ ID NO: 2137 - DNA, 106 bp, Homo sapiens; identical to SEQ ID NO: 2130
  modified_base (29)..(46): a, c, t, g, unknown or other

SEQ ID NO: 2138 - DNA, 110 bp, Homo sapiens; identical to SEQ ID NO: 2135
  modified_base (29)..(46): a, c, t, g, unknown or other

SEQ ID NO: 2139 - DNA, 98 bp, Homo sapiens
  modified_base (29)..(46): a, c, t, g, unknown or other
aaagaaagaaagaaagagagagagagagnnnnnnnnnnnnnnnnnnaaagaaagaaagaaagaaagaaagaaagaaagaaagaaagaaagaaagaaag

SEQ ID NO: 2140 - DNA, 102 bp, Homo sapiens; identical to SEQ ID NO: 2129
  modified_base (29)..(46): a, c, t, g, unknown or other

SEQ ID NO: 2141 - DNA, 114 bp, Homo sapiens; identical to SEQ ID NO: 2134
  modified_base (29)..(46): a, c, t, g, unknown or other

SEQ ID NO: 2142 - DNA, 118 bp, Homo sapiens; identical to SEQ ID NO: 2133
  modified_base (29)..(46): a, c, t, g, unknown or other

SEQ ID NO: 2143 - DNA, 102 bp, Homo sapiens; identical to SEQ ID NO: 2129
  modified_base (29)..(46): a, c, t, g, unknown or other

SEQ ID NO: 2144 - DNA, 106 bp, Homo sapiens; identical to SEQ ID NO: 2130
  modified_base (29)..(46): a, c, t, g, unknown or other

SEQ ID NO: 2145 - DNA, 64 bp, Homo sapiens; identical to SEQ ID NO: 173

SEQ ID NO: 2146 - DNA, 60 bp, Homo sapiens
aataaataaataaatacataaataaataaataaataaataaataaataaataaataaata

SEQ ID NO: 2147 - DNA, 96 bp, Homo sapiens
tctatctatctatctatgtatgtatctatctatgtatgtatctatctatctatctatctatctatctatctatctatctatctatctatctatcta

SEQ ID NO: 2148 - DNA, 92 bp, Homo sapiens
tctatctatctatctatgtatgtatctatctatgtatgtatctatctatctatctatctatctatctatctatctatctatctatctatcta

SEQ ID NO: 2149 - DNA, 104 bp, Homo sapiens
  misc_feature (49)..104): This region may encompass 13-14 "tcta" repeating units
tctatctatctatctatgtatgtatctatctatgtatgtatctatctatctatctatctatctatctatctatctatctatctatctatctatctatctatcta

SEQ ID NO: 2150 - DNA, 100 bp, Homo sapiens
tctatctatctatctatgtatgtatctatctatgtatgtatctatctatctatctatctatctatctatctatctatctatctatctatctatctatcta

SEQ ID NO: 2151 - DNA, 100 bp, Homo sapiens; identical to SEQ ID NO: 2150

SEQ ID NO: 2152 - DNA, 96 bp, Homo sapiens; identical to SEQ ID NO: 2147

SEQ ID NO: 2153 - DNA, 96 bp, Homo sapiens; identical to SEQ ID NO: 2147

SEQ ID NO: 2154 - DNA, 92 bp, Homo sapiens; identical to SEQ ID NO: 2148

SEQ ID NO: 2155 - DNA, 96 bp, Homo sapiens; identical to SEQ ID NO: 2147

SEQ ID NO: 2156 - DNA, 92 bp, Homo sapiens; identical to SEQ ID NO: 2148

SEQ ID NO: 2157 - DNA, 92 bp, Homo sapiens; identical to SEQ ID NO: 2148

SEQ ID NO: 2158 - DNA, 96 bp, Homo sapiens; identical to SEQ ID NO: 2147

SEQ ID NO: 2159 - DNA, 60 bp, Homo sapiens
aaataaataaataaatacatacatacatacatacatacatacatacatacatacatacat

SEQ ID NO: 2160 - DNA, 56 bp, Homo sapiens
aaataaataaataaatacatacatacatacatacatacatacatacatacatacat

SEQ ID NO: 2161 - DNA, 44 bp, Homo sapiens; identical to SEQ ID NO: 572

SEQ ID NO: 2162 - DNA, 48 bp, Homo sapiens; identical to SEQ ID NO: 1121

SEQ ID NO: 2163 - DNA, 44 bp, Homo sapiens; identical to SEQ ID NO: 138

SEQ ID NO: 2164 - DNA, 48 bp, Homo sapiens; identical to SEQ ID NO: 124

SEQ ID NO: 2165 - DNA, 52 bp, Homo sapiens; identical to SEQ ID NO: 19

SEQ ID NO: 2166 - DNA, 56 bp, Homo sapiens
aaataaataaataaataaataaataaataaataaataaataaataaataaataaat

SEQ ID NO: 2167 - DNA, 85 bp, Homo sapiens
ttttattttattttattttattttattttattttattttattttattttattttattttattttattttattttattttatttta

SEQ ID NO: 2168 - DNA, 90 bp, Homo sapiens
ttttattttattttattttattttattttattttattttattttattttattttattttattttattttattttattttattttatttta

SEQ ID NO: 2169 - DNA, 80 bp, Homo sapiens
ttttattttattttattttattttattttattttattttattttattttattttattttattttattttattttatttta

SEQ ID NO: 2170 - DNA, 75 bp, Homo sapiens
ttttattttattttattttattttattttattttattttattttattttattttattttattttattttatttta

SEQ ID NO: 2171 - DNA, 119 bp, Homo sapiens
ttttattttattttattttattttattttattttattttattttattttatttattttattttattttattttattttattttattttattttattttattttattttattttatttta

SEQ ID NO: 2172 - DNA, 124 bp, Homo sapiens; identical to SEQ ID NO: 184

SEQ ID NO: 2173 - DNA, 80 bp, Homo sapiens; identical to SEQ ID NO: 2169

SEQ ID NO: 2174 - DNA, 85 bp, Homo sapiens; identical to SEQ ID NO: 2167

SEQ ID NO: 2175 - DNA, 85 bp, Homo sapiens; identical to SEQ ID NO: 2167

SEQ ID NO: 2176 - DNA, 80 bp, Homo sapiens; identical to SEQ ID NO: 2169

SEQ ID NO: 2177 - DNA, 52 bp, Homo sapiens
atctatctatctatctatctatctatctatctatctatctatctatctatct

SEQ ID NO: 2178 - DNA, 56 bp, Homo sapiens
atctatctatctatctatctatctatctatctatctatctatctatctatctatct

SEQ ID NO: 2179 - DNA, 56 bp, Homo sapiens; identical to SEQ ID NO: 2178

SEQ ID NO: 2180 - DNA, 60 bp, Homo sapiens
atctatctatctatctatctatctatctatctatctatctatctatctatctatctatct

SEQ ID NO: 2181 - DNA, 52 bp, Homo sapiens; identical to SEQ ID NO: 2177

SEQ ID NO: 2182 - DNA, 48 bp, Homo sapiens; identical to SEQ ID NO: 32

SEQ ID NO: 2183 - DNA, 52 bp, Homo sapiens; identical to SEQ ID NO: 2177

SEQ ID NO: 2184 - DNA, 48 bp, Homo sapiens; identical to SEQ ID NO: 32

SEQ ID NO: 2185 - DNA, 52 bp, Homo sapiens; identical to SEQ ID NO: 2177

SEQ ID NO: 2186 - DNA, 56 bp, Homo sapiens; identical to SEQ ID NO: 2178

SEQ ID NO: 2187 - DNA, 122 bp, Homo sapiens
  modified_base (13)..(24): a, c, t, g, unknown or other
  modified_base (85)..(106): a, c, t, g, unknown or other
tagatagatagannnnnnnnnnnntaggtaggtaggtagatagatagatagatagatagatagatagatagatagatagatagannnnnnnnnnnnnnnnnnnnnntagatagatagataga

SEQ ID NO: 2188 - DNA, 118 bp, Homo sapiens
  modified_base (13)..(24): a, c, t, g, unknown or other
  modified_base (81)..(102): a, c, t, g, unknown or other
tagatagatagannnnnnnnnnnntaggtaggtaggtagatagatagatagatagatagatagatagatagatagatagannnnnnnnnnnnnnnnnnnnnntagatagatagataga

SEQ ID NO: 2189 - DNA, 118 bp, Homo sapiens; identical to SEQ ID NO: 2188
  modified_base (13)..(24): a, c, t, g, unknown or other
  modified_base (81)..(102): a, c, t, g, unknown or other

SEQ ID NO: 2190 - DNA, 122 bp, Homo sapiens; identical to SEQ ID NO: 2187
  modified_base (13)..(24): a, c, t, g, unknown or other
  modified_base (85)..(106): a, c, t, g, unknown or other

SEQ ID NO: 2191 - DNA, 122 bp, Homo sapiens; identical to SEQ ID NO: 2187
  modified_base (13)..(24): a, c, t, g, unknown or other
  modified_base (85)..(106): a, c, t, g, unknown or other

SEQ ID NO: 2192 - DNA, 118 bp, Homo sapiens; identical to SEQ ID NO: 2188
  modified_base (13)..(24): a, c, t, g, unknown or other
  modified_base (81)..(102): a, c, t, g, unknown or other

SEQ ID NO: 2193 - DNA, 126 bp, Homo sapiens
  modified_base (13)..(24): a, c, t, g, unknown or other
  modified_base (89)..(110): a, c, t, g, unknown or other
tagatagatagannnnnnnnnnnntaggtaggtaggtagatagatagatagatagatagatagatagatagatagatagatagatagannnnnnnnnnnnnnnnnnnnnntagatagatagataga

SEQ ID NO: 2194 - DNA, 122 bp, Homo sapiens; identical to SEQ ID NO: 2187
  modified_base (13)..(24): a, c, t, g, unknown or other
  modified_base (85)..(106): a, c, t, g, unknown or other

SEQ ID NO: 2195 - DNA, 126 bp, Homo sapiens; identical to SEQ ID NO: 2193
  modified_base (13)..(24): a, c, t, g, unknown or other
  modified_base (89)..(110): a, c, t, g, unknown or other

SEQ ID NO: 2196 - DNA, 122 bp, Homo sapiens; identical to SEQ ID NO: 2187
  modified_base (13)..(24): a, c, t, g, unknown or other
  modified_base (85)..(106): a, c, t, g, unknown or other

SEQ ID NO: 2197 - DNA, 90 bp, Homo sapiens
cctcctcctcctcctctttcttcttcttctccttcttcttcttcttcttcttcttcttcttcttcttcttcttcttcttcttcttcttct

SEQ ID NO: 2198 - DNA, 40 bp, Homo sapiens
gatagatagatagatagatagatagatagatagatagata

SEQ ID NO: 2199 - DNA, 52 bp, Homo sapiens
gatagatagatagatagatagatagatagatagatagatacatacatacata

What is claimed is:

1. A method of determining a selection of Y-STR markers for a male individual, the method comprising determining the allele of at least seven Y-STR markers selected from the group consisting of DYF387S1, DYF399S1, DYF403S1, DYF404S1, DYS449, DYS518, DYS526, DYS547, DYS570, DYS576, DYS612, DYS626 and DYS627.

2. The method of claim 1, wherein the allele is identified by PCR.

3. The method of claim 2, wherein the PCR is multiplex PCR that co-amplifies the at least four markers.

4. The method of claim 2, wherein the PCR uses primers that are labeled with a fluorescent dye.

5. The method of claim 1, wherein the allele is identified by mass spectroscopy, capillary electrophoresis, or gel electrophoresis.

6. The method of claim 2, wherein the PCR co-amplifies the at least four markers and an autosomal STR.

7. The method of claim 6, wherein the autosomal STR is selected from the group consisting of D3S1358, vWA, FGA, D8S1179, D21S11, D18S51, D5S818, D13S317, D7S820, D16S539, THO1, TPOX, and CSF1PO.

8. The method of claim 1, comprising determining the allele of at least eight Y-STR markers selected from the group consisting of DYF387S1, DYF399S1, DYF403S1, DYF404S1, DYS449, DYS518, DYS526, DYS547, DYS570, DYS576, DYS612, DYS626 and DYS627.

9. A method of determining a selection of Y-STR markers for a male individual, the method comprising determining the allele of at least six Y-STR markers selected from the group consisting of DYF387S1, DYF399S1, DYF404S1, DYS449, DYS526, DYS547, DYS570, DYS576, DYS612, DYS626 and DYS627.

10. The method of claim 9, wherein the allele is identified by PCR.

11. The method of claim 10, wherein the PCR is multiplex PCR that co-amplifies the at least two markers.

12. The method of claim 10, wherein the PCR uses primers that are labeled with a fluorescent dye.

13. The method of claim 9, wherein the allele is identified by mass spectroscopy, capillary electrophoresis, or gel electrophoresis.

14. The method of claim 10, wherein the PCR co-amplifies the at least two markers and an autosomal STR.

15. The method of claim 14, wherein the autosomal STR is selected from the group consisting of D3S1358, vWA, FGA, D8S1179, D21S11, D18S51, D5S818, D13S317, D7S820, D16S539, THO1, TPOX, and CSF1PO.

16. The method of claim 9, comprising determining the allele of at least seven Y-STR markers selected from the group consisting of DYF387S1, DYF399S1, DYF404S1, DYS449, DYS526, DYS547, DYS570, DYS576, DYS612, DYS626 and DYS627.

17. The method of claim 9, comprising determining the allele of at least eight Y-STR markers selected from the group consisting of DYF387S1, DYF399S1, DYF404S1, DYS449, DYS526, DYS547, DYS570, DYS576, DYS612, DYS626 and DYS627.

* * * * *